(12) United States Patent
Narain et al.

(10) Patent No.: US 11,694,765 B2
(45) Date of Patent: *Jul. 4, 2023

(54) INTERROGATORY CELL-BASED ASSAYS FOR IDENTIFYING DRUG-INDUCED TOXICITY MARKERS

(71) Applicant: Berg LLC, Framingham, MA (US)

(72) Inventors: Niven Rajin Narain, Cambridge, MA (US); Rangaprasad Sarangarajan, Boylston, MA (US); Vivek K. Vishnudas, Bedford, MA (US)

(73) Assignee: Berg LLC, Framingham, MA (US)

( * ) Notice: Subject to any disclaimer, the term of this patent is extended or adjusted under 35 U.S.C. 154(b) by 962 days.

This patent is subject to a terminal disclaimer.

(21) Appl. No.: 16/180,446

(22) Filed: Nov. 5, 2018

(65) Prior Publication Data

US 2019/0304566 A1 Oct. 3, 2019

Related U.S. Application Data

(63) Continuation of application No. 13/607,630, filed on Sep. 7, 2012, now abandoned.

(60) Provisional application No. 61/650,462, filed on May 22, 2012.

(51) Int. Cl.
```
G16B 5/00        (2019.01)
G16B 20/00       (2019.01)
C12Q 1/6837      (2018.01)
C12Q 1/6883      (2018.01)
G16B 20/20       (2019.01)
G16B 20/50       (2019.01)
```

(52) U.S. Cl.
CPC ............. *G16B 5/00* (2019.02); *C12Q 1/6837* (2013.01); *C12Q 1/6883* (2013.01); *G16B 20/00* (2019.02); *G16B 20/20* (2019.02); *G16B 20/50* (2019.02); *C12Q 2600/142* (2013.01); *C12Q 2600/158* (2013.01)

(58) Field of Classification Search
CPC ...... A61P 9/04; A61P 9/00; A61P 9/06; A61P 39/02; A61P 39/00; G16B 20/20; G16B 20/00; G16B 5/00; G16B 20/50; C12Q 1/6837; C12Q 2600/142; C12Q 2600/158; C12Q 1/6883
See application file for complete search history.

(56) References Cited

U.S. PATENT DOCUMENTS

| | | |
|---|---|---|
| 6,858,383 B2 | 2/2005 | Sabbadini |
| 6,964,850 B2 | 11/2005 | Bevilacqua et al. |
| 7,883,858 B2 | 2/2011 | Hood et al. |
| 8,263,325 B2 | 9/2012 | De Bold |
| 10,352,947 B2 | 7/2019 | Narain et al. |
| 2003/0225009 A1 | 12/2003 | Rosen et al. |
| 2006/0019888 A1 | 1/2006 | Zhou |
| 2007/0054269 A1 | 3/2007 | Mendrick et al. |
| 2007/0218457 A1 | 9/2007 | McKim |
| 2008/0208784 A1* | 8/2008 | Hill et al. ........... 706/46 |
| 2009/0169585 A1 | 7/2009 | Sardi |
| 2009/0202995 A1 | 8/2009 | Mendrick et al. |
| 2010/0183607 A1 | 7/2010 | Hazen et al. |
| 2010/0278787 A1 | 11/2010 | Sartipy et al. |
| 2011/0003707 A1 | 1/2011 | Goix et al. |
| 2011/0059089 A1 | 3/2011 | Swagemakers et al. |
| 2011/0136690 A1 | 6/2011 | Hood et al. |
| 2011/0275563 A1 | 11/2011 | Attramadal et al. |
| 2012/0058088 A1 | 3/2012 | Sardi |
| 2013/0045873 A1 | 2/2013 | Hood et al. |
| 2013/0315885 A1 | 11/2013 | Narain et al. |
| 2014/0100128 A1 | 4/2014 | Narain et al. |

FOREIGN PATENT DOCUMENTS

| | | |
|---|---|---|
| JP | 2005-517400 A | 6/2005 |
| MX | 358408 B | 8/2018 |
| WO | 2003/068908 A2 | 8/2003 |
| WO | 2004/063334 A2 | 7/2004 |
| WO | 2007/084187 A2 | 7/2007 |
| WO | 2012/024296 A1 | 2/2012 |
| WO | 2012/119129 A1 | 9/2012 |

OTHER PUBLICATIONS

Chiellini et al., Characterization of human mesenchymal stem cell secretome at early steps of adipocyte and osteoblast differentiation. BMC Mol Biol. Feb. 26, 2008;9:26. 16 pages.

Dumont et al., Preferential Induction of the AhR gene battery in HepaRG Cells after a Single or Repeated Exposure to Heterocyclic Aromatic Amines. Toxicology and Applied Pharmacology. 2010;249:91-100.

Ghule et al., Effect of pretreatment with coenzyme Q10 on isoproterenol-induced cardiotoxicity and cardiac hypertrophy in rats. Curr Ther Res Clin Exp. Dec. 2009;70(6):460-71.

Hashimoto et al., Importance of genetic background for risk of relapse shown in altered prefrontal cortex gene expression during abstinence following chronic alcohol intoxication. Neuroscience. Jan. 26, 2011;173:57-75.

HGNC Symbol Report: CCDC47. Retrieved online at: http://www.genenames.org/cgi-bin/gene_symbol_report?hgnc_id=24856. 1 page, accessed online on Dec. 7, 2016.

Jefferies et al., Dilated cardiomyopathy. Lancet. Feb. 27, 2010;375(9716):752-62.

Liebler et al., Elucidating mechanisms of drug-induced toxicity. Nat Rev Drug Discov. May 2005;4(5):410-20.

(Continued)

*Primary Examiner* — Satyendra K Singh

(74) *Attorney, Agent, or Firm* — McCarter & English, LLP; Jill Mello; Anita M. Bowles

(57) ABSTRACT

Described herein is a discovery Platform Technology for analyzing a drug-induced toxicity condition, such as cardiotoxicity via model building.

17 Claims, 35 Drawing Sheets

Specification includes a Sequence Listing.

(56) References Cited

OTHER PUBLICATIONS

Mori et al., Identification of potential genomic biomarkers for early detection of chemically induced cardiotoxicity in rats. Toxicology. Apr. 30, 2010;271(1-2):36-44.

Reichart, DNA microarray based gene expression profiling in human hepatocyte cells to serve as a basis for dynamic modelling of the human liver—a systems biology approach. Institute for Technical Biochemistry, University of Stuttgart, 365 pages. (2008).

Salio et al., Cardioprotective function of the long pentraxin PTX3 in acute myocardial infarction. Circulation. Feb. 26, 2008;117(8):1055-64.

Sawyer et al., Daunorubicin-induced apoptosis in rat cardiac myocytes is inhibited by dexrazoxane. Circ Res. Feb. 19, 1999;84(3):257-65.

Sukumaran et al., Olmesartan, an AT1 antagonist, attenuates oxidative stress, endoplasmic reticulum stress and cardiac inflammatory mediators in rats with heart failure induced by experimental autoimmune myocarditis. Int J Biol Sci. Feb. 11, 2011;7(2):154-67.

Viguerie et al., Multiple effects of a short-term dexamethasone treatment in human skeletal muscle and adipose tissue. Physiol Genomics. Feb. 1, 2012;44(2):141-51.

Zhang et al., Calumin, a novel $Ca^{2+}$-binding transmembrane protein on the endoplasmic reticulum. Cell Calcium. Jul. 2007;42(1):83-90.

* cited by examiner

(Normal vs. Diabetic) Vs. (Diabetic T1 vs. Diabetic)

Compare the unique edges of Normal in the normal vs. disease delta network with the unique edges of Disease T1 in the disease vs. disease T1 delta network. Edges in the intersection of normal and disease T1 are disease edges that were restored to normal when treated with T1.

Fig. 15A
Data Processing

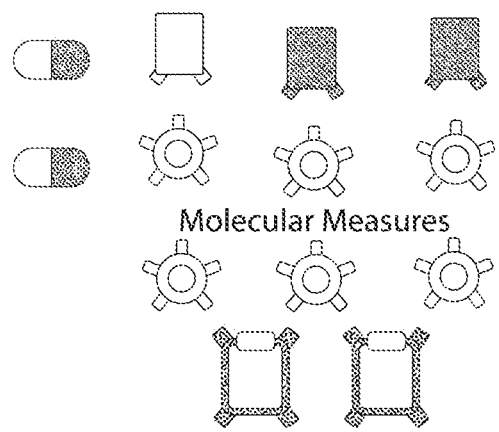

Molecular Measures

Fig. 15B
Bayesian Fragment Enumeration

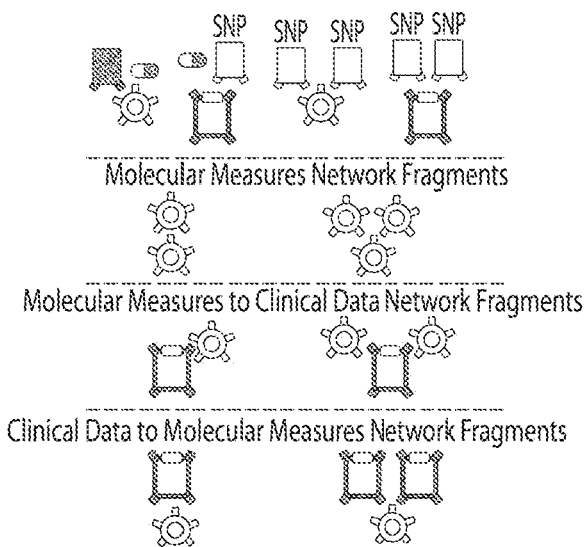

Drug and Genotype to Phenotype Network Fragments

Molecular Measures Network Fragments

Molecular Measures to Clinical Data Network Fragments

Clinical Data to Molecular Measures Network Fragments

Fig. 15C
Parallel Ensemble Sampling

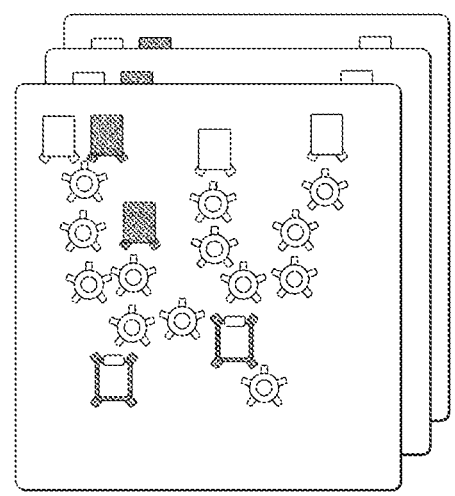

Ensemble of Models

Fig. 15D
Model Intervention Simulation

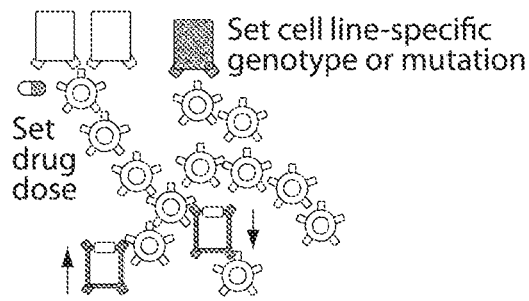

Set cell line-specific genotype or mutation

Set drug dose

INTERROGATORY CELL-BASED ASSAYS FOR IDENTIFYING DRUG-INDUCED TOXICITY MARKERS

CROSS-REFERENCE TO RELATED APPLICATIONS

This application is a continuation of U.S. patent application Ser. No. 13/607,630, filed on Sep. 7, 2012, pending, which claims priority to U.S. Provisional Application Ser. No. 61/650,462, filed on May 22, 2012, the entire contents of which are hereby incorporated herein by reference.

SEQUENCE LISTING

The instant application contains a Sequence Listing which has been submitted in ASCII format via EFS-Web and is hereby incorporated by reference in its entirety. Said ASCII copy, "119992-06503_Seq_List.txt" was created on Nov. 5, 2018 and is 1.82 megabytes in size.

BACKGROUND OF THE INVENTION

The pharmaceutical industry is currently witnessing a 90% attrition of potential compounds entering clinical development, 30% of which is owing to poor clinical safety (Kola et al. (2004) *Nat Rev Drug Discovery:* 3 711-715). In the U.S., fatal adverse drug reactions (ADRs) are the $4^{th}$ to $6^{th}$ leading causes of death. Costs directly attributable to ADRs may lead to an additional $1.56 to $4 billion in direct hospital costs per year in the U.S. (Lazarou J et al. (1998) *JAMA;* 279(15):1200-1225). The cost of drug discovery and development has increased to about $1 billion, partly due to increased attrition of compounds and NME late in clinical development (Adams C P, Brantner V V (2010) "*Spending on New Drug Development" Health Econ.* 19: 130-141). The lack of reliable tools that can help with predicting toxicity early in drug development is partly to blame for increasing costs and lower return on investment. Further, drug safety issues are the leading cause of increased litigation and settlements in the pharmaceutical industry. Between January 2009 and May 2011 the industry has spent over USD 8 billion on litigation cases related to drug safety issues.

In order to augment a "kill early policy" of compounds in early clinical trials and drug development, the FDA is now encouraging the drug industry and the community to adopt a very innovative strategy. FDA white paper *Innovation or Stagnation: Challenges and Opportunity on the Critical Path to New Medical Projects* states, "A new product development toolkit containing powerful new scientific and technical methods such as animal or computer-based predictive models, biomarkers for safety and effectiveness, and new clinical evaluation techniques—is urgently needed to improve predictability and efficiency along the critical path from laboratory concept to commercial product" (FDA, 2005). The FDA declaration clearly underscores the lack of innovative technologies that can aid in efficient decision making in drug development.

Cardiotoxicity refers to a broad range of adverse effects on heart function induced by therapeutic molecules. Cardiotoxicity may emerge early in pre-clinical studies or become apparent later in the clinical setting. It is a leading cause of drug withdrawal, accounting for over 45% of all drugs withdrawn since 1994, which results in significant financial burden for drug development. Cardiovascular toxicity includes increased QT duration, arrhythmias, myocardial ischemia, hypertension and thromboembolic complications, and myocardial dysfunction.

Cardiac safety biomarkers currently used by the FDA are QTc prolongation-lectrophysiological arrhythmias, circulating troponin c, heart rate, blood pressure, lipids, troponin, C-reactive protein (CRP), brain ot B-type natriuretic peptide (BNP), ex vivo platelet aggregation, and imaging biomarkers (cardiac magnetic resonance imaging). The QTc prolongation is a very robust but complex marker. However, a decision on whether to kill or sustain a drug in early development is hard to make based on QTc alone. In addition, QTc is subjective and is dependent upon underlying pathologies that can lead to tachyarrythmias.

In view of the foregoing, it is evident that new cardiac safety biomarkers, such as molecular cardiac safety biomarkers, are needed in the art.

SUMMARY OF THE INVENTION

The platform technology described herein is useful for identifying markers associated with drug-induced toxicity. This platform technology integrates molecular interactions within and across a hierarchy of models starting from primary human cell based model to human clinical samples. This approach leads to the identification of biomarkers that reflect an underlying toxicity caused by a compound or NME that is a potential drug, such as a drug candidate ready to enter phase I clinical trials. Drug induced toxicities can include cardiac, renal, hepatic and other tissue toxicity. The instant application provides several novel biomarkers associated with drug-induced toxicity, and which are useful in methods for predicting potential toxicity of a molecule or drug candidate, and as potential therapeutic targets for treating, preventing or counteracting drug-induced toxicity.

The invention described herein is based, at least in part, on a novel, collaborative utilization of network biology, genomic, proteomic, metabolomic, transcriptomic, and bioinformatics tools and methodologies, which, when combined, may be used to study any biological system of interest, such as obtaining insight into the molecular mechanisms associated with or causal for drug-induced toxicity. The platform technology is further described in international PCT Application PCT/US2012/027615, the entire contents of which are hereby expressly incorporated herein. Additional embodiments of the platform technology, including a description of how to carry out platform technology methods involving incorporation of enzyme (e.g., kinase) activity data, are described in U.S. application Ser. No. 13/607,587, filed on Sep. 7, 2012, the entire contents of which are expressly incorporated herein by reference. In a first step, cellular modeling systems are developed to probe a drug-induced toxicities, such as cardiotoxicity, hepatotoxicity, nephrotoxicity, neurotoxicity, renaltoxicity or myotoxicity. A cellular system modeling drug-induced toxicity can comprise toxicity-related cells subjected to various-relevant environment stimuli (e.g., hyperglycemia, hypoxia, immuno-stress, and lipid peroxidation, or exposure to a test molecule or drug candidate). In some embodiments, the cellular modeling system involves cellular cross-talk mechanisms between various interacting cell types related to specific drug-induced toxicity, such as cardiomyocytes, diabetic cardiomyocytes, hepatocytes, kidney cells, neuronal cells, renal cells, or myoblasts. High throughput biological readouts from the cell model system are obtained by using a combination of techniques, including, for example, cutting edge mass spectrometry (LC/MSMS), flow cytometry, cell-based assays, and functional assays. The high throughput biological readouts are then subjected to a bioinformatic analysis to study congruent data trends by in vitro, in vivo, and in silico modeling. The resulting matrices allow for cross-related data mining where linear and non-linear regression analysis were developed to reach conclusive pressure points (or "hubs"). These "hubs", as presented herein, are candidates for drug discovery. In particular, these hubs represent potential drug targets for reducing or alleviating drug-induced toxicity and/or drug-induced toxicity markers.

The molecular signatures of the differentials allow for insight into the mechanisms that dictate the alterations in the tissue microenvironment that lead to drug-induced toxicity. Taken together, the combination of the aforementioned technology platform with strategic cellular modeling allows for robust intelligence that can be employed to further establish an understanding of the underlying mechanisms and molecular drivers contributing to drug-induced toxicity, e.g., cardiotoxicity, hepatotoxicity, nephrotoxicity, neurotoxicity, renal toxicity or myotoxicity while creating biomarker libraries that may allow early identification of drug candidates at risk for causing drug-induced toxic effects, as well as drug targets that may reduce or alleviate drug-induced toxicity.

A significant feature of the platform of the invention is that the AI-based system is based on the data sets obtained from the drug-induced toxicity cell model system, without resorting to or taking into consideration any existing knowledge in the art, such as known biological relationships (i.e., no data points are artificial), concerning the drug-induced toxicity. Accordingly, the resulting statistical models generated from the platform are unbiased. Another significant feature of the platform of the invention and its components, e.g., the cell model systems and data sets obtained therefrom, is that it allows for continual building on the drug-induced toxicity cell models over time (e.g., by the introduction of new cells and/or conditions), such that an initial, "first generation" consensus causal relationship network generated from a cell model for a drug-induced toxicity can evolve along with the evolution of the cell model itself to a multiple generation causal relationship network (and delta or delta-delta networks obtained therefrom). In this way, both the drug-induced toxicity cell models, the data sets from the drug-induced toxicity cell models, and the causal relationship networks generated from the drug-induced toxicity cell models by using the Platform Technology methods can constantly evolve and build upon previous knowledge obtained from the Platform Technology.

The present invention is based, at least in part, on the identification of novel biomarkers that are associated with drug-induced cardiotoxicity. The invention is further based, at least in part, on the discovery that Coenzyme Q10 is capable of reducing or preventing drug-induced cardiotoxicity.

Accordingly, the invention provides methods for identifying an agent that causes or is at risk for causing cardiotoxicity. In one embodiment, the agent is a drug or drug candidate. In one embodiment, the toxicity is drug-induced toxicity, e.g., cardiotoxicity. In one embodiment, the agent is a drug or drug candidate for treating diabetes, obesity, a cardiovascular disorder, cancer, a neurological disorder, or an inflammatory disorder. In these methods, the amount of one or more biomarkers/proteins in a pair of samples (a first sample not subject to the drug treatment, and a second sample subjected to the drug treatment) is assessed. A modulation in the level, expression level, or activity of the one or more biomarkers in the second sample as compared to the level of expression of the one or more biomarkers in the first sample is an indication that the drug causes or is at risk for causing drug-induced cardiotoxicity. In one embodiment, the one or more biomarkers is selected from the markers listed in table 2. The methods of the present invention can be practiced in conjunction with any other method used by the skilled practitioner to identify a drug at risk for causing drug-induced cardiotoxocity.

In one embodiment, a drug that may be used in the methods of the invention includes, but is not limited to, Anthracyclines, 5-Fluorouracil, Cisplatin, Trastuzumab, Gemcitabine, Rosiglitazone, Pioglitazone, Troglitazone, Cabergoline, Pergolide, Sumatriptan, Bisphosphonates, and TNF antagonists.

Accordingly, in one aspect, the invention provides a method for identifying a drug that causes or is at risk for causing drug-induced cardiotoxicity, comprising: comparing (i) the level of expression of one or more biomarkers present in a first cell sample obtained prior to the treatment with the drug; with (ii) the level of expression of the one or more biomarkers present in a second cell sample obtained following the treatment with the drug; wherein the one or more biomarkers is selected from the markers listed in table 2; wherein a modulation in the level of expression of the one or more biomarkers in the second sample as compared to the first sample is an indication that the drug causes or is at risk for causing drug-induced cardiotoxicity. In one embodiment, the cells are cells of the cardiovascular system, e.g., cardiomyocytes. In one embodiment, the cells are diabetic cardiomyocytes. In one embodiment, the drug is a drug or candidate drug for treating diabetes, obesity, cardiovascular disease, cancer, neurological disorder, or inflammatory disorder. In one embodiment, the drug is any one of Anthracyclines, 5-Fluorouracil, Cisplatin, Trastuzumab, Gemcitabine, Rosiglitazone, Pioglitazone, Troglitazone, Cabergoline, Pergolide, Sumatriptan, Bisphosphonates, and TNF antagonists.

In one embodiment, a modulation (e.g., an increase or a decrease) in the level of expression of one, two, three, four, five, six, seven, eight, nine, ten, 11, 12, 13, 14, 15, 16, 17, 18, 19, 20, 25, 30, 35, 40, 50, 60, 70, 80, 90, 100, 110, 120, 130, 140, 150, 160, or more of the biomarkers selected from the markers listed in table 2 in the second sample as compared to the first sample is an indication that the drug causes or is at risk for causing drug-induced cardiotoxicity.

In one embodiment, a modulation (e.g., an increase or a decrease) in the level of expression of a panel of two, three, four, five, six, seven, eight, nine, ten, eleven, twelve, or thirteen markers selected from a group consisting TIMP1, PTX3, HSP76, FINC, CYB5, PAI1, IBP7 (IGFBP7), 1C17, EDIL3, HMOX1, NUCB1, CS010, HSPA4 in the second sample as compared to the first sample is an indication that the drug causes or is at risk for causing drug-induced cardiotoxicity.

Methods for identifying a rescue agent that can reduce or prevent drug-induced cardiotoxicity are also provided by the invention. In these methods, the amount of one or more biomarkers in three samples (a first sample not subjected to the drug treatment, a second sample subjected to the drug treatment, and a third sample subjected both to the drug treatment and the agent) is assessed. A normalized level of expression of the one or more biomarkers in the third sample as compared to the first sample, with a change of expression in the second example treated with the drug, is an indication that the rescue agent can reduce or prevent drug-induced cardiotoxicity. In one embodiment, the one or more biomarkers is selected from the markers listed in table 2.

Using the methods described herein, a variety of molecules, particularly including molecules sufficiently small to be able to cross the cell membrane, may be screened in order to identify molecules which modulate, e.g., increase or decrease the expression and/or activity of a marker of the invention. Compounds so identified can be provided to a subject in order to reduce, alleviate or prevent drug-induced toxicity in the subject.

Accordingly, in another aspect, the invention provides a method for identifying a rescue agent that can reduce or prevent drug-induced cardiotoxicity comprising: (i) determining a normal level of expression of one or more biomarkers present in a first cell sample obtained prior to the treatment with a cardiotoxicity inducing drug; (ii) determining a treated level of expression of the one or more biomarkers present in a second cell sample obtained following the treatment with the cardiotoxicity inducing drug to identify one or more biomarkers with a change of expression in the treated cell sample; (iii) determining the level of expression of the one or more biomarkers with a changed level of expression in the cardiotoxicity inducing drug treated sample present in a third cell sample obtained following the treatment with the cardiotoxicity inducing drug and the rescue agent; and (iv) comparing the level of expression of the one or more biomarkers determined in the third sample with the level of expression of the one or more biomarkers present in the first sample; wherein the one or more biomarkers is selected from the markers listed in table 2; and wherein a normalized level of expression of the one or more biomarkers in the third sample as compared to the first sample is an indication that the rescue agent can reduce or prevent drug-induced cardiotoxicity.

In one embodiment, the cells are cells of the cardiovascular system, e.g., cardiomyocytes. In one embodiment, the cells are diabetic cardiomyocytes. In one embodiment, the drug is a drug or candidate drug for treating diabetes, obesity, cardiovascular disease, cancer, neurological disorder, or inflammatory disorder. In one embodiment, the drug is any one of Anthracyclines, 5-Fluorouracil, Cisplatin, Trastuzumab, Gemcitabine, Rosiglitazone, Pioglitazone, Troglitazone, Cabergoline, Pergolide, Sumatriptan, Bisphosphonates, and TNF antagonists. In one embodiment, about the same level of expression of one, two, three, four, five, six, seven, eight, nine, 10, 11, 12, 13, 14, 15, 16, 17, 18, 19, 20, 25, 30, 35, 40, 50, 60, 70, 80, 90, 100, 110, 120, 130, 140, 150, 160, or more of the biomarkers selected from the markers listed in table 2 in the third sample as compared to the first sample is an indication that the rescue agent can reduce or prevent drug-induced cardiotoxicity.

In one embodiment, a normalized level of expression of a panel of two, three, four, five, six, seven, eight, nine, ten, eleven, twelve, or thirteen, markers selected from a group consisting TIMP1, PTX3, HSP76, FINC, CYB5, PAI1, IBP7 (IGFBP7), 1C17, EDIL3, HMOX1, NUCB1, CS010, HSPA4, in the third sample as compared to the first sample is an indication that the rescue agent can reduce or prevent drug-induced cardiotoxicity.

The invention further provides methods for alleviating, reducing or preventing drug-induced cardiotoxicity in a subject in need thereof, comprising administering to a subject (e.g., a mammal, a human, or a non-human animal) an agent identified by the screening methods provided herein, thereby reducing or preventing drug-induced cardiotoxicity in the subject. In one embodiment, the agent is administered to a subject that has already been treated with a cardiotoxicity-inducing drug. In one embodiment, the agent is administered to a subject at the same time as treatment of the subject with a cardiotoxicity-inducing drug. In one embodiment, the agent is administered to a subject prior to treatment of the subject with a cardiotoxicity-inducing drug.

The invention further provides methods for alleviating, reducing or preventing drug-induced cardiotoxicity in a subject in need thereof, comprising administering Coenzyme Q10 to the subject (e.g., a mammal, a human, or a non-human animal), thereby reducing or preventing drug-induced cardiotoxicity in the subject. In one embodiment, the Coenzyme Q10 is administered to a subject that has already been treated with a cardiotoxicity-inducing drug. In one embodiment, the Coenzyme Q10 is administered to a subject at the same time as treatment of the subject with a cardiotoxicity-inducing drug. In one embodiment, the Coenzyme Q10 is administered to a subject prior to treatment of the subject with a cardiotoxicity-inducing drug. In one embodiment, the drug-induced cardiotoxicity is associated with modulation of expression of one, two, three, four, five, six, seven, eight, nine, 10, 11, 12, 13, 14, 15, 16, 17, 18, 19, 20, 25, 30, 35, 40, 50, 60, 70, 80, 90, 100, 110, 120, 130, 140, 150, 160, or more of the biomarkers selected from the markers listed in table 2. All values presented in the foregoing list can also be the upper or lower limit of ranges, that are intended to be a part of this invention, e.g., between 1 and 5, 1 and 10, 2 and 5, 2 and 10, or 5 and 10 of the foregoing genes (or proteins).

In one embodiment, the drug-induced cardiotoxicity is cardiomyopathy, heart failure, atrial fibrillation, cardiomyopathy and heart failure, heart failure and LV dysfunction, atrial flutter and fibrillation, or heart valve damage and heart failure.

The invention further provides biomarkers (e.g, genes and/or proteins) that are useful as predictive markers for drug-induced cardiotoxicity. These biomarkers include the markers listed in table 2.

In one embodiment, the drug-induced cardiotoxicity is associated with modulation of a panel of two, three, four, five, six, seven, eight, nine, ten, eleven, twelve, or thirteen, markers selected from a group consisting TIMP1, PTX3, HSP76, FINC, CYB5, PAI1, IBP7 (IGFBP7), 1C17, EDIL3, HMOX1, NUCB1, CS010, HSPA4.

In one embodiment, the predictive markers for drug-induced cardiotoxicity is a panel of two, three, four, five, six, seven, eight, nine, ten, eleven, twelve, or thirteen markers selected from a group consisting TIMP1, PTX3, HSP76, FINC, CYB5, PAI1, IBP7 (IGFBP7), 1C17, EDIL3, HMOX1, NUCB1, CS010, HSPA4.

The ordinary skilled artisan would, however, be able to identify additional biomarkers predictive of drug-induced cardiotoxicity by employing the methods described herein, e.g., by carrying out the methods described in Example 3 but by using a different drug known to induce cardiotoxicity. Exemplary drug-induced cardiotoxicity biomarkers of the invention are further described below.

In one aspect, the invention relates to a method for identifying a modulator of a drug-induced toxicity, said method comprising: (1) establishing a model for drug-induced toxicity, using cells associated with drug-induced toxicity, to represents a characteristic aspect of drug-induced toxicity; (2) obtaining a first data set from the model for drug-induced toxicity, wherein the first data set represents one or more of genomics, lipidomics, proteomics, metabolomics, transcriptomics, and single nucleotide polymorphism (SNP) data characterizing the cells associated with drug-induced toxicity; (3) obtaining a second data set from the model for drug-induced toxicity, wherein the second data set represents a functional activity or a cellular response of the cells associated with drug-induced toxicity; (4) generating a consensus causal relationship network among the expression levels of the one or more of genomics, lipidomics, proteomics, metabolomics, transcriptomics, and single nucleotide polymorphism (SNP) data and the functional activity or cellular response based solely on the first data set and the second data set using a programmed computing device, wherein the generation of the consensus causal relationship network is not based on any known biological relationships other than the first data set and the second data set; (5) identifying, from the consensus causal relationship network, a causal relationship unique in drug-induced toxicity, wherein a gene, lipid, protein, metabolite, transcript, or SNP associated with the unique causal relationship is identified as a modulator of drug-induced toxicity.

In certain embodiments, the modulator stimulates or promotes the drug-induced toxicity.

In certain embodiments, the modulator inhibits the drug-induced toxicity.

In certain embodiments, the model of the drug-induced toxicity comprises an in vitro culture of cells associated with the drug-induced toxicity, optionally further comprising a matching in vitro culture of control cells.

In certain embodiments, the in vitro culture of the cells is subject to an environmental perturbation, and the in vitro culture of the matching control cells is identical cells not subject to the environmental perturbation.

In certain embodiments, the environmental perturbation comprises one or more of a contact with an agent, a change in culture condition, an introduced genetic modification/mutation, and a vehicle (e.g., vector) that causes a genetic modification/mutation.

In certain embodiments, the first data set comprises protein and/or mRNA expression levels of the plurality of genes.

In certain embodiments, the first data set further comprises two or more of genomics, lipidomics, proteomics, metabolomics, transcriptomics, and single nucleotide polymorphism (SNP) data. In certain embodiments, the first data set further comprises three or more of genomics, lipidomics, proteomics, metabolomics, transcriptomics, and single nucleotide polymorphism (SNP) data.

In certain embodiments, the second data set representing the functional activity or cellular response of the cells comprises one or more of bioenergetics, cell proliferation, apoptosis, organellar function, a genotype-phenotype association actualized by functional models selected from ATP, ROS, OXPHOS, and Seahorse assays, global enzyme activity, and an effect of global enzyme activity on the enzyme metabolic substrates of cells associated with drug-induced toxicity. In one embodiment, the global enzyme activity is global kinase activity. In one embodiment, the effect of global enzyme activity on the enzyme metabolic substrates is the phospho proteome of the cell.

In certain embodiments, step (4) is carried out by an artificial intelligence (AI)-based informatics platform.

In certain embodiments, the AI-based informatics platform comprises REFS™.

In certain embodiments, the AI-based informatics platform receives all data input from the first data set and the second data set without applying a statistical cut-off point.

In certain embodiments, the consensus causal relationship network established in step (4) is further refined to a simulation causal relationship network, before step (5), by in silico simulation based on input data, to provide a confidence level of prediction for one or more causal relationships within the consensus causal relationship network.

In certain embodiments, the unique causal relationship is identified as part of a differential causal relationship network that is uniquely present in cells, and absent in the matching control cells.

In one embodiment, the unique causal relationship identified is a relationship between at least one pair selected from the group consisting of expression of a gene and level of a lipid; expression of a gene and level of a transcript; expression of a gene and level of a metabolite; expression of a first gene and a second gene; expression of a gene and presence of a SNP; expression of a gene and a functional activity; level of a lipid and level of a transcript; level of a lipid and level of a metabolite; level of a first lipid and a second lipid; level of a lipid and presence of a SNP; level of a lipid and a functional activity; level of a first transcript and level of a second transcript; level of a transcript and level of a metabolite; level of a transcript and presence of a SNP; level of a first transcript and a functional activity; level of a first metabolite and level of a second metabolite; level of a metabolite and presence of a SNP; level of a metabolite and a functional activity; level of a first SNP and presence of a second SNP; and presence of a SNP and a functional activity.

In one embodiment, the functional activity is selected from the group consisting of bioenergetics, cell proliferation, apoptosis, organellar function, kinase activity, protease activity, and a genotype-phenotype association actualized by functional models selected from ATP, ROS, OXPHOS, and Seahorse assays. In certain embodiments, the method further comprising validating the identified unique causal relationship in a drug-indiced toxicity model.

In one embodiment, the drug-induced toxicity is drug-induced cardiotoxicity, hepatotoxicity, nephrotoxicity, neurotoxicity, renaltoxicity or myotoxicity.

In one embodiment, the drug-induced cardiotoxicity is cardiomyopathy, heart failure, atrial fibrillation, cardiomyopathy and heart failure, heart failure and LV dysfunction, atrial flutter and fibrillation, or, heart valve damage and heart failure.

In one embodiment, the model for drug-induced toxicity comprises cardiomyocytes, diabetic cardiomyocytes, hepatocytes, kidney cells, neuronal cells, renal cells, or myoblasts.

In one embodiment, the model for drug-induced toxicity comprises a toxicity inducing drug, cancer drug, diabetic drug, neurological drug, or anti-inflammatory drug. In one embodiment, the drug is Anthracyclines, 5-Fluorouracil, Cisplatin, Trastuzumab, Gemcitabine, Rosiglitazone, Pioglitazone, Troglitazone, Cabergoline, Pergolide, Sumatriptan, Bisphosphonates, or TNF antagonists.

In one aspect, the invention provides a method for identifying a drug that causes or is at risk for causing drug-induced toxicity, comprising: comparing (i) a level of one or more biomarkers present in a first cell sample obtained prior to the treatment with the drug; with (ii) a level of the one or more biomarkers present in a second cell sample obtained following the treatment with the drug; wherein the one or more biomarkers is selected from the modulators identified by the methods described above; wherein a modulation in the level of the one or more biomarkers in the second sample as compared to the first sample is an indication that the drug causes or is at risk for causing drug-induced toxicity.

In one aspect, the invention provides a method for identifying a rescue agent that can reduce or prevent drug-induced toxicity comprising: (i) determining a normal level of one or more biomarkers present in a first cell sample obtained prior to the treatment with a toxicity inducing drug; (ii) determining a treated level of the one or more biomarkers present in a second cell sample obtained following the treatment with the toxicity inducing drug to identify one or more biomarkers with a change of level in the treated cell sample; (iii) determining the level of the one or more biomarkers with a changed level in the toxicity inducing drug treated sample present in a third cell sample obtained following the treatment with the toxicity inducing drug and the rescue agent; and (iv) comparing the level of the one or more biomarkers determined in the third sample with the level of the one or more biomarkers present in the first sample; wherein the one or more biomarkers is selected from the modulators identified by the methods described above and wherein a normalized level of the one or more biomarkers in the third sample as compared to the first sample is an indication that the rescue agent can reduce or prevent drug-induced toxicity.

In another aspect, the invention relates to a method for alleviating, reducing or preventing drug-induced toxicity, comprising administering to a subject the rescue agent identified by the methods described above, thereby reducing or preventing drug-induced toxicity in the subject.

In another aspect, the invention relates to a method for providing a model for drug-induced toxicity for use in a platform method, comprising: establishing a drug-induced toxicity model, using cells associated with the drug-induced toxicity, to represent a characteristic aspect of the drug-induced toxicity, wherein the model for the drug-induced toxicity is useful for generating data sets used in the platform method; thereby providing a model for drug-induced toxicity for use in a platform method.

In one embodiment, the model for drug-induced toxicity comprises cardiomyocytes, diabetic cardiomyocytes, hepatocytes, kidney cells, neuronal cells, renal cells, or myoblasts.

In another aspect, the invention relates to a method for obtaining a first data set and second data set from a model for drug-induced toxicity for use in a platform method, comprising: (1) obtaining a first data set from the model for drug-induced toxicity for use in a platform method, wherein the model for the drug-induced toxicity comprises cells associated with the drug-induced toxicity, and wherein the first data set represents expression levels of a plurality of genes in the cells associated with the drug-induced toxicity; (2) obtaining a second data set from the model for drug-induced toxicity for use in the platform method, wherein the second data set represents a functional activity or a cellular response of the cells associated with the drug-induced toxicity; thereby obtaining a first data set and second data set from the model for the drug-induced toxicity for use in a platform method.

In another aspect, the invention relates to a method for identifying a modulator of drug-induced toxicity, said method comprising: (1) generating a consensus causal relationship network among a first data set and second data set obtained from a model for the drug-induced toxicity, wherein the model comprises cells associated with the drug-induced toxicity, and wherein the first data set represents expression levels of a plurality of genes in the cells and the second data set represents a functional activity or a cellular response of the cells, using a programmed computing device, wherein the generation of the consensus causal relationship network is not based on any known biological relationships other than the first data set and the second data set; (2) identifying, from the consensus causal relationship network, a causal relationship unique in the drug-induced toxicity, wherein a gene associated with the unique causal relationship is identified as a modulator of the drug-induced toxicity; thereby identifying a modulator of drug-induced toxicity.

In another aspect, the invention relates to a method for identifying a modulator of a drug-induced toxicity, said method comprising: 1) providing a consensus causal relationship network generated from a model for the drug-induced toxicity; 2) identifying, from the consensus causal relationship network, a causal relationship unique in the drug-induced toxicity, wherein a gene associated with the unique causal relationship is identified as a modulator of the drug-induced toxicity; thereby identifying a modulator of a drug-induced toxicity.

In certain embodiments of the various methods, the consensus causal relationship network is generated among a first data set and second data set obtained from the model for the drug-induced toxicity, wherein the model comprises cells associated with the drug-induced toxicity, and wherein the first data set represents expression levels of a plurality of genes in the cells and the second data set represents a functional activity or a cellular response of the cells, using a programmed computing device, wherein the generation of the consensus causal relationship network is not based on any known biological relationships other than the first data set and the second data set.

In certain embodiments, the "environmental perturbation", also referred to herein as "external stimulus component", is a therapeutic agent. In certain embodiments, the external stimulus component is a small molecule (e.g., a small molecule of no more than 5 kDa, 4 kDa, 3 kDa, 2 kDa, 1 kDa, 500 Dalton, or 250 Dalton). In certain embodiments, the external stimulus component is a biologic. In certain embodiments, the external stimulus component is a chemical. In certain embodiments, the external stimulus component is endogenous or exogenous to cells. In certain embodiments, the external stimulus component is a MIM or epishifter. In certain embodiments, the external stimulus component is a stress factor for the cell system, such as hypoxia, hyperglycemia, hyperlipidemia, hyperinsulinemia, and/or lactic acid rich conditions.

In certain embodiments, the external stimulus component may include a therapeutic agent or a candidate therapeutic agent for treating a drug-induced toxicity, including chemotherapeutic agent, protein-based biological drugs, antibodies, fusion proteins, small molecule drugs, lipids, polysaccharides, nucleic acids, etc.

In certain embodiments, the external stimulus component may be one or more stress factors, such as those typically encountered in vivo under the various drug-induced toxicities, including hypoxia, hyperglycemic conditions, acidic environment (that may be mimicked by lactic acid treatment), etc.

In other embodiments, the external stimulus component may include one or more MIMs and/or epishifters, as defined herein below. Exemplary MIMs include Coenzyme Q10 (also referred to herein as CoQ10) and compounds in the Vitamin B family, or nucleosides, mononucleotides or dinucleotides that comprise a compound in the Vitamin B family.

In making cellular output measurements (such as protein expression), either absolute amount (e.g., expression amount) or relative level (e.g., relative expression level) may be used. In one embodiment, absolute amounts (e.g., expression amounts) are used. In one embodiment, relative levels or amounts (e.g., relative expression levels) are used. For example, to determine the relative protein expression level of a cell system, the amount of any given protein in the cell system, with or without the external stimulus to the cell system, may be compared to a suitable control cell line or mixture of cell lines (such as all cells used in the same experiment) and given a fold-increase or fold-decrease value. The skilled person will appreciate that absolute amounts or relative amounts can be employed in any cellular output measurement, such as gene and/or RNA transcription level, level of lipid, level of metabolite, or any functional output, e.g., level of apoptosis, level of toxicity, level of enzyme (e.g., kinase) activity, or ECAR or OCR as described herein. A pre-determined threshold level for a fold-increase (e.g., at least 1.2, 1.3, 1.4, 1.5, 1.6, 1.7, 1.8, 1.9, 2, 2.5, 3, 3.5, 4, 4.5, 5, 6, 7, 8, 9, 10, 15, 20, 25, 30, 35, 40, 45, 50, 75 or 100 or more fold increase) or fold-decrease (e.g., at least a decrease to 0.9, 0.8, 0.75, 0.7, 0.6, 0.5, 0.45, 0.4, 0.35, 0.3, 0.25, 0.2, 0.15, 0.1 or 0.05 fold, or a decrease to 90%, 80%, 75%, 70%, 65%, 60%, 55%, 50%, 45%, 40%, 35%, 30%, 25%, 20%, 15%, 10% or 5% or less) may be used to select significant differentials, and the cellular output data for the significant differentials may then be included in the data sets (e.g., first and second data sets) utilized in the platform technology methods of the invention. All values presented in the foregoing list can also be the upper or lower limit of ranges, e.g., between 1.5 and 5 fold, 5 and 10 fold, 2 and 5 fold, or between 0.9 and 0.7, 0.9 and 0.5, or 0.7 and 0.3 fold, are intended to be a part of this invention.

Throughout the present application, all values presented in a list, e.g., such as those above, can also be the upper or lower limit of ranges that are intended to be a part of this invention.

In one embodiment of the methods of the invention, not every observed causal relationship in a causal relationship network may be of biological significance. With respect to any given drug-induced toxicity for which the subject interrogative biological assessment is applied, some (or maybe all) of the causal relationships (and the genes associated therewith) may be "determinative" with respect to the specific biological problem at issue, e.g., either responsible for causing a drug-induced toxicity (a potential target for therapeutic intervention) or is a biomarker for the drug-induced toxicity (a potential diagnostic or prognostic factor). In one embodiment, an observed causal relationship unique in the drug-induced toxicity is determinative with respect to the specific biological problem at issue. In one embodiment, not every observed causal relationship unique in the drug-induced toxicity is determinative with respect to the specific problem at issue.

Such determinative causal relationships may be selected by an end user of the subject method, or it may be selected by a bioinformatics software program, such as REFS, DAVID-enabled comparative pathway analysis program, or the KEGG pathway analysis program. In certain embodiments, more than one bioinformatics software program is used, and consensus results from two or more bioinformatics software programs are preferred.

As used herein, "differentials" of cellular outputs include differences (e.g., increased or decreased levels) in any one or more parameters of the cellular outputs. In certain embodiments, the differentials are each independently selected from the group consisting of differentials in mRNA transcription, protein expression, lipid expression, protein activity, kinase activity, metabolite/intermediate level, and/or ligand-target interaction. For example, in terms of protein expression level, differentials between two cellular outputs, such as the outputs associated with a cell system before and after the treatment by an external stimulus component, can be measured and quantitated by using art-recognized technologies, such as mass-spectrometry based assays (e.g., iTRAQ, 2D-LC-MSMS, etc.).

In one aspect, the cell model for a drug-induced toxicity comprises a cellular cross-talking system, wherein a first cell system having a first cellular environment with an external stimulus component generates a first modified cellular environment; such that a cross-talking cell system is established by exposing a second cell system having a second cellular environment to the first modified cellular environment.

In one embodiment, at least one significant cellular cross-talking differential from the cross-talking cell system is generated; and at least one determinative cellular cross-talking differential is identified such that an interrogative biological assessment occurs. In certain embodiments, the at least one significant cellular cross-talking differential is a plurality of differentials.

In certain embodiments, the at least one determinative cellular cross-talking differential is selected by the end user. Alternatively, in another embodiment, the at least one determinative cellular cross-talking differential is selected by a bioinformatics software program (such as, e.g., REFS, KEGG pathway analysis or DAVID-enabled comparative pathway analysis) based on the quantitative proteomics data.

In certain embodiments, the method further comprises generating a significant cellular output differential for the first cell system.

In certain embodiments, the differentials are each independently selected from the group consisting of differentials in mRNA transcription, protein expression, lipid expression, protein activity, metabolite/intermediate level, and/or ligand-target interaction.

In certain embodiments, the first cell system and the second cell system are independently selected from: a homogeneous population of primary cells, a drug-induced toxicity related cell line, or a normal cell line.

In certain embodiments, the first modified cellular environment comprises factors secreted by the first cell system into the first cellular environment, as a result of contacting the first cell system with the external stimulus component. The factors may comprise secreted proteins or other signaling molecules. In certain embodiments, the first modified cellular environment is substantially free of the original external stimulus component.

In certain embodiments, the cross-talking cell system comprises a transwell having an insert compartment and a well compartment separated by a membrane. For example, the first cell system may grow in the insert compartment (or the well compartment), and the second cell system may grow in the well compartment (or the insert compartment).

In certain embodiments, the cross-talking cell system comprises a first culture for growing the first cell system, and a second culture for growing the second cell system. In this case, the first modified cellular environment may be a conditioned medium from the first cell system.

In certain embodiments, the first cellular environment and the second cellular environment can be identical. In certain embodiments, the first cellular environment and the second cellular environment can be different.

In certain embodiments, the cross-talking cell system comprises a co-culture of the first cell system and the second cell system.

The methods of the invention may be used for, or applied to, any number of "interrogative biological assessments." Application of the methods of the invention to an interrogative biological assessment allows for the identification of one or more modulators of a drug-induced toxicity or determinative cellular process "drivers" of a drug-induced toxicity.

In one embodiment, the interrogative biological assessment is the assessment of the toxicological profile of an agent, e.g., a drug, on a cell, tissue, organ or organism, wherein the identified modulators of drug-induced toxicity, e.g., determinative cellular process driver (e.g., cellular cross-talk differentials or causal relationships unique in drug-induced toxicity) may be indicators of toxicity, e.g., cytotoxicity, cardiotoxicity, hepatotoxicity, nephrotoxicity, neurotoxicity, renaltoxicity or myotoxicity, and may in turn be used to predict or identify the toxicological profile of the agent. In one embodiment, the identified modulators of a drug-induced toxicity, e.g., determinative cellular process driver (e.g., cellular cross-talk differentials or causal relationships unique in a drug-induced toxicity) is an indicator of cardiotoxicity of a drug or drug candidate, and may in turn be used to predict or identify the cardiotoxicological profile of the drug or drug candidate.

In another aspect, the invention provides a kit for conducting an interrogative biological assessment using a discovery Platform Technology, comprising one or more reagents for detecting the presence of, and/or for quantitating the amount of, an analyte that is the subject of a causal relationship network generated from the methods of the invention. In one embodiment, said analyte is the subject of a unique causal relationship in the drug-induced toxicity, e.g., a gene associated with a unique causal relationship in the drug-induced toxicity. In certain embodiments, the analyte is a protein, and the reagents comprise an antibody against the protein, a label for the protein, and/or one or more agents for preparing the protein for high throughput analysis (e.g., mass spectrometry based sequencing).

It should be understood that all embodiments described herein, including those described only in examples, are parts of the general description of the invention, and can be combined with any other embodiments of the invention unless explicitly disclaimed or inapplicable.

BRIEF DESCRIPTION OF THE DRAWINGS

Various embodiments of the present disclosure will be described herein below with reference to the figures wherein:

FIGS. 15A-15D: High level schematic illustration of the components and process for an AI-based informatics system that may be used with exemplary embodiments. Specifically, FIG. 15A schematically depicts data processing. FIG. 15B schematically depicts Bayesian fragment enumeration. FIG. 15C schematically depicts parallel ensemble sampling. FIG. 15D schematically depicts model intervention simulation.

Figure 1:
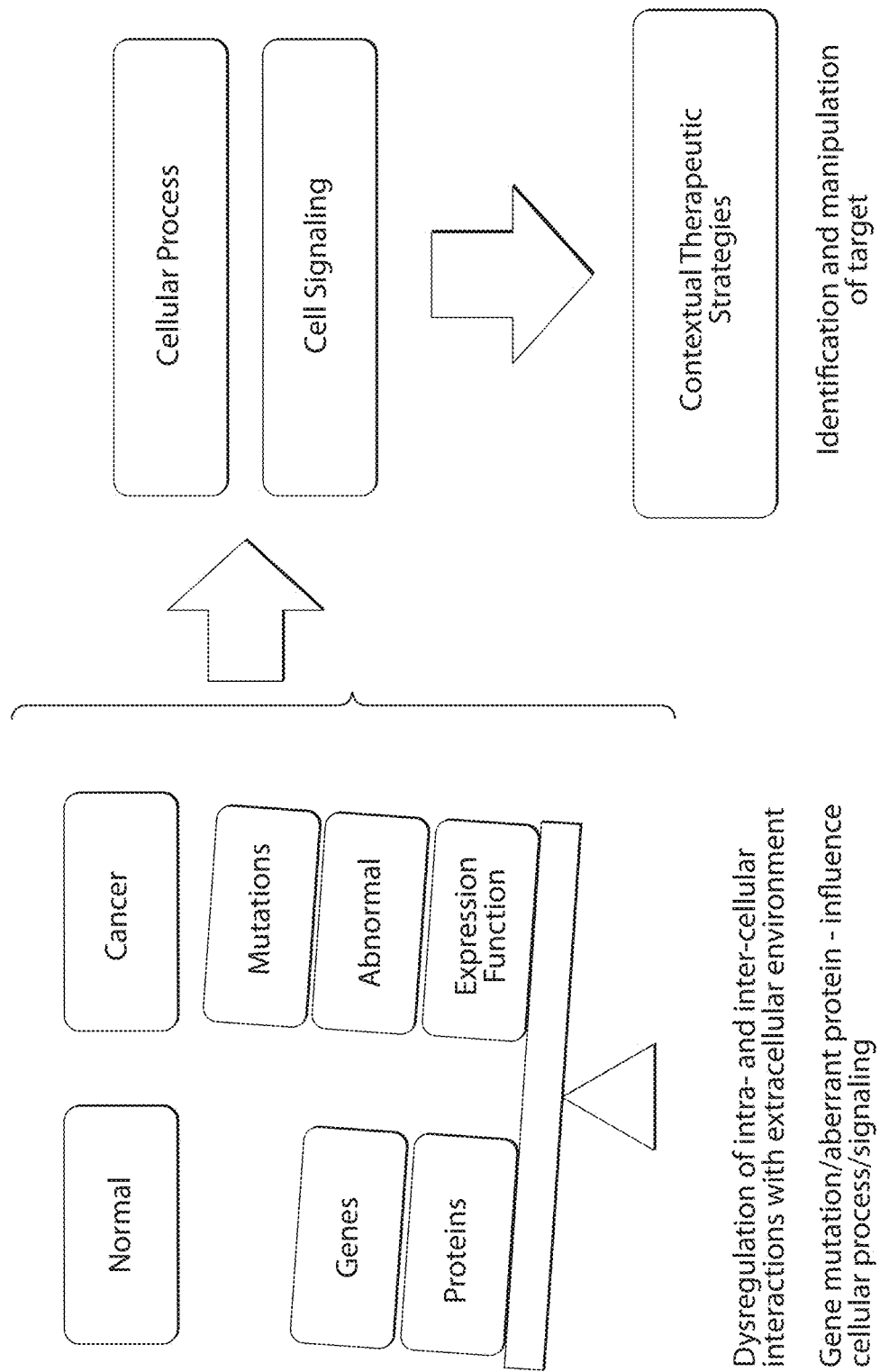
FIG. 1: Illustration of approach to identify therapeutics.

Attached herewith, as in Appendix A, are the sequences of all biomarkers referenced herein. All of the information associated with the Gene Bank accession numbers listed in Appendix A and through this application are incorporated herein by reference in the versions available on the filing date of this application.

DETAILED DESCRIPTION OF THE INVENTION

I. Overview

Exemplary embodiments of the present invention incorporate methods that may be performed using an interrogative biology platform ("the Platform") that is a tool for understanding a wide variety of drug-induced toxicities, such as cardiotoxicity, hepatotoxicity, nephrotoxicity, neurotoxicity, renaltoxicity or myotoxicity, and the key molecular drivers underlying such drug-induced toxicities, including factors that enable a drug-induced toxicity. Some exemplary embodiments include systems that may incorporate at least a portion of, or all of, the Platform. Some exemplary methods may employ at least some of, or all of the Platform. Goals and objectives of some exemplary embodiments involving the platform are generally outlined below for illustrative purposes:

i) to create specific molecular signatures as drivers of critical components of the drug-induced toxicity as they relate to overall pathophysiology of the relevant cells, tissues, and/or organs;

ii) to generate molecular signatures or differential maps pertaining to the drug-induced toxicity, which may help to identify differential molecular signatures that distinguishes one biological state (e.g., a drug-induced toxicity state) versus a different biological stage (e.g., a normal state), and develop understanding of signatures or molecular entities as they arbitrate mechanisms of change between the two biological states (e.g., from normal to drug-induced toxicity state); and, iii) to investigate the role of "hubs" of molecular activity as potential intervention targets for external control of the drug-induced toxicity (e.g., to use the hub as a potential therapeutic target), or as potential bio-markers for the drug-induced toxicity in question (e.g., drug-induced toxicity specific biomarkers, in prognostic and/or theranostics uses).

Some exemplary methods involving the Drug-induced Toxicity Platform may include one or more of the following features:

1) modeling the drug-induced toxicities (e.g., cardiotoxicity, hepatotoxicity, nephrotoxicity, neurotoxicity, renaltoxicity, or myotoxicity) and/or components of the drug-induced toxicity (e.g., physiology & pathophysiology associated with toxicities) in one or more models, preferably in vitro models, using cells associated with the drug-induced toxicity. For example, the cells may be human derived cells which normally participate in the drug-induced toxicity in question (e.g., heat muscle cells involved in cardiotoxicity). The model may include various cellular cues/conditions/perturbations that are specific to the drug-induced toxicity. Ideally, the model represents various drug-induced toxicity states and flux components, instead of a static assessment of the drug-induced toxicity condition.

2) profiling mRNA and/or protein signatures using any art-recognized means. For example, quantitative polymerase chain reaction (qPCR) & proteomics analysis tools such as Mass Spectrometry (MS). Such mRNA and protein data sets represent biological reaction to environment/perturbation. Where applicable and possible, lipidomics, metabolomics, and transcriptomics data may also be integrated as supplemental or alternative measures for the drug-induced toxicity in question. SNP analysis is another component that may be used at times in the process. It may be helpful for investigating, for example, whether the SNP or a specific mutation has any effect on the drug-induced toxicity. These variables may be used to describe the drug-induced toxicity, either as a static "snapshot," or as a representation of a dynamic process.

3) assaying for one or more functional activities or cellular responses to cues and perturbations, including but not limited to bioenergetics, cell proliferation, apoptosis, and organellar function. True genotype-phenotype association is actualized by employment of functional models, such as ATP, ROS, OXPHOS, Seahorse assays, etc. Such functional activities can involve global enzyme activity, such as kinase activity, and/or effects of global enzyme activity or the enzyme metabolites or substrates in the cells, e.g., the phosphor proteome of the cells. Such cellular responses represent the reaction of the cells in the drug-induced toxicity process (or models thereof) in response to the corresponding drug-induced toxicity state(s) of the mRNA/protein expression, and any other related states in 2) above.

4) integrating functional assay data thus obtained in 3) with proteomics and other data obtained in 2), and determining protein, gene, lipid, enzyme activity and other functional activity associations as driven by causality, by employing artificial intelligence based (AI-based) informatics system or platform. Such an AI-based system is based on, and preferably based only on, the data sets obtained in 2) and/or 3), without resorting to existing knowledge concerning the drug-induced toxicity process. Preferably, no data points are statistically or artificially cut-off. Instead, all obtained data is fed into the AI-system for determining protein, gene, lipid, enzyme activity and other functional activity associations. One goal or output of the integration process is one or more differential networks (otherwise may be referred to herein as "delta networks," or, in some cases, "delta-delta networks" as the case may be) between the different biological states (e.g., drug-induced toxicity vs. normal states).

5) profiling the outputs from the AI-based informatics platform to explore each hub of activity as a potential therapeutic target and/or biomarker. Such profiling can be done entirely in silico based on the obtained data sets, without resorting to any actual wet-lab experiments.

6) validating hub of activity by employing molecular and cellular techniques. Such post-informatic validation of output with wet-lab cell-based experiments may be optional, but they help to create a full-circle of interrogation.

Any or all of the approaches outlined above may be used in any specific application concerning any drug-induced toxicity, depending, at least in part, on the nature of the specific application. That is, one or more approaches outlined above may be omitted or modified, and one or more additional approaches may be employed, depending on specific application.

Figure 2:
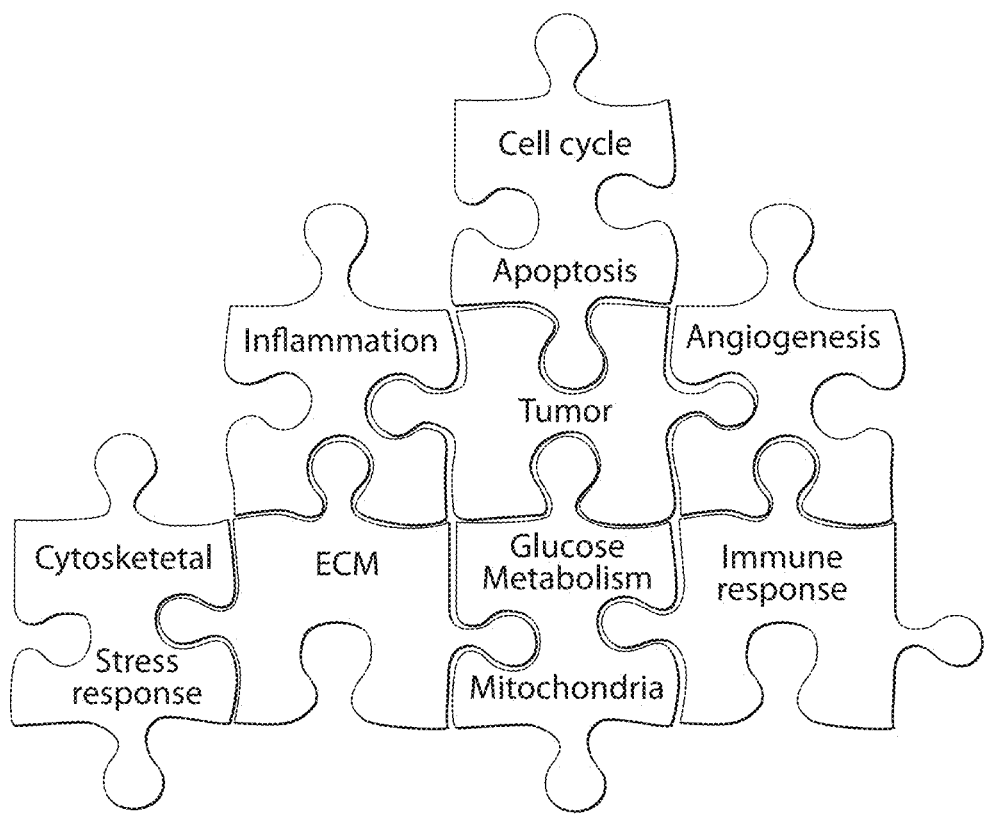
FIG. 2: Illustration of systems biology of cancer and consequence of integrated multi-physiological interactive output regulation.
Figure 3:
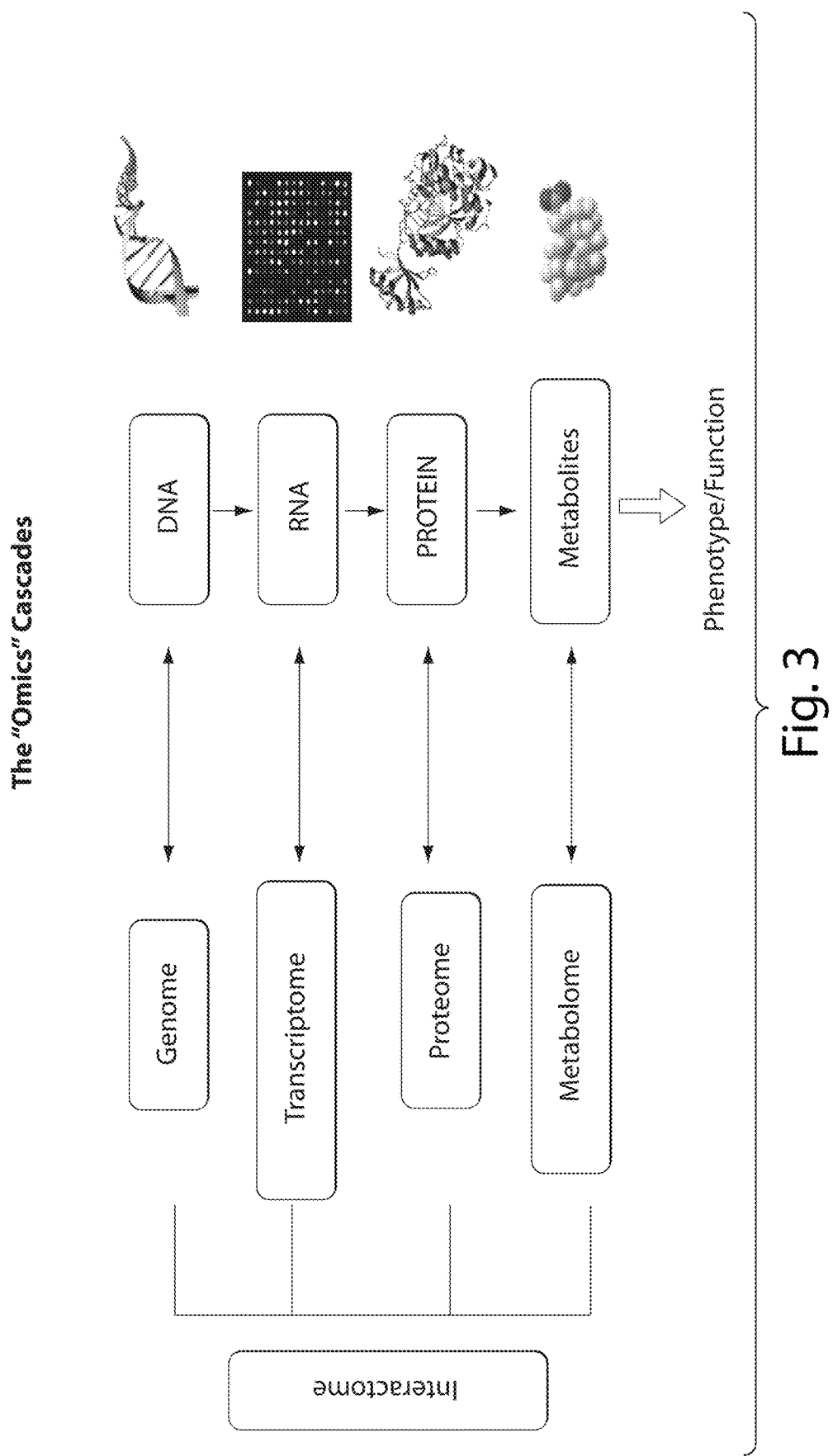
FIG. 3: Illustration of systematic interrogation of biological relevance using MIMS.
Figure 4:
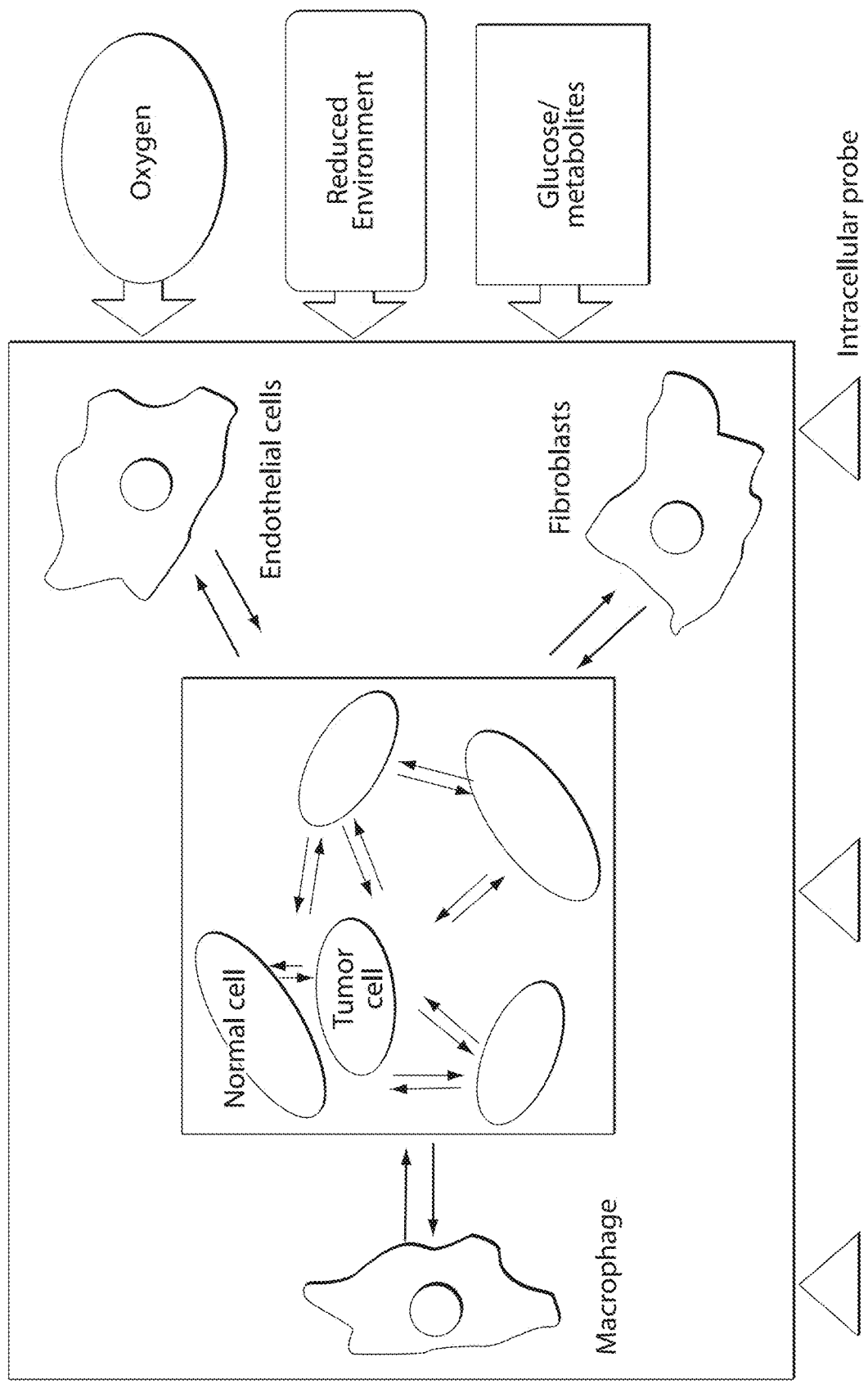
FIG. 4: Illustration of modeling cancer network to enable interrogative biological query.

Various schematics illustrating the platform are provided. In particular, an illustration of an exemplary approach to identify therapeutics using the platform is depicted in FIG. 1. An illustration of systems biology of cancer and the consequence of integrated multi-physiological interactive output regulation is depicted in FIG. 2. An illustration of a systematic interrogation of biological relevance using MIMS is depicted in FIG. 3. An illustration of modeling a cancer network to enable an interrogative biological query is depicted in FIG. 4.

Figure 5:
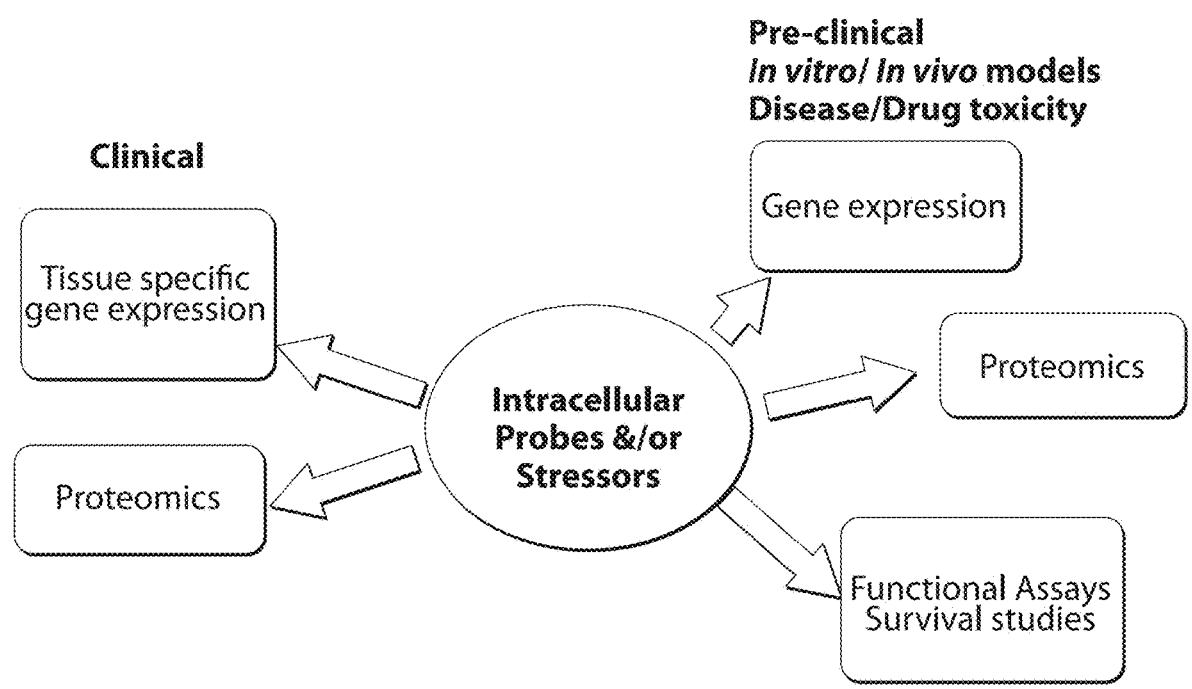
FIG. 5: Illustration of the interrogative biology platform technology.
Figure 6:
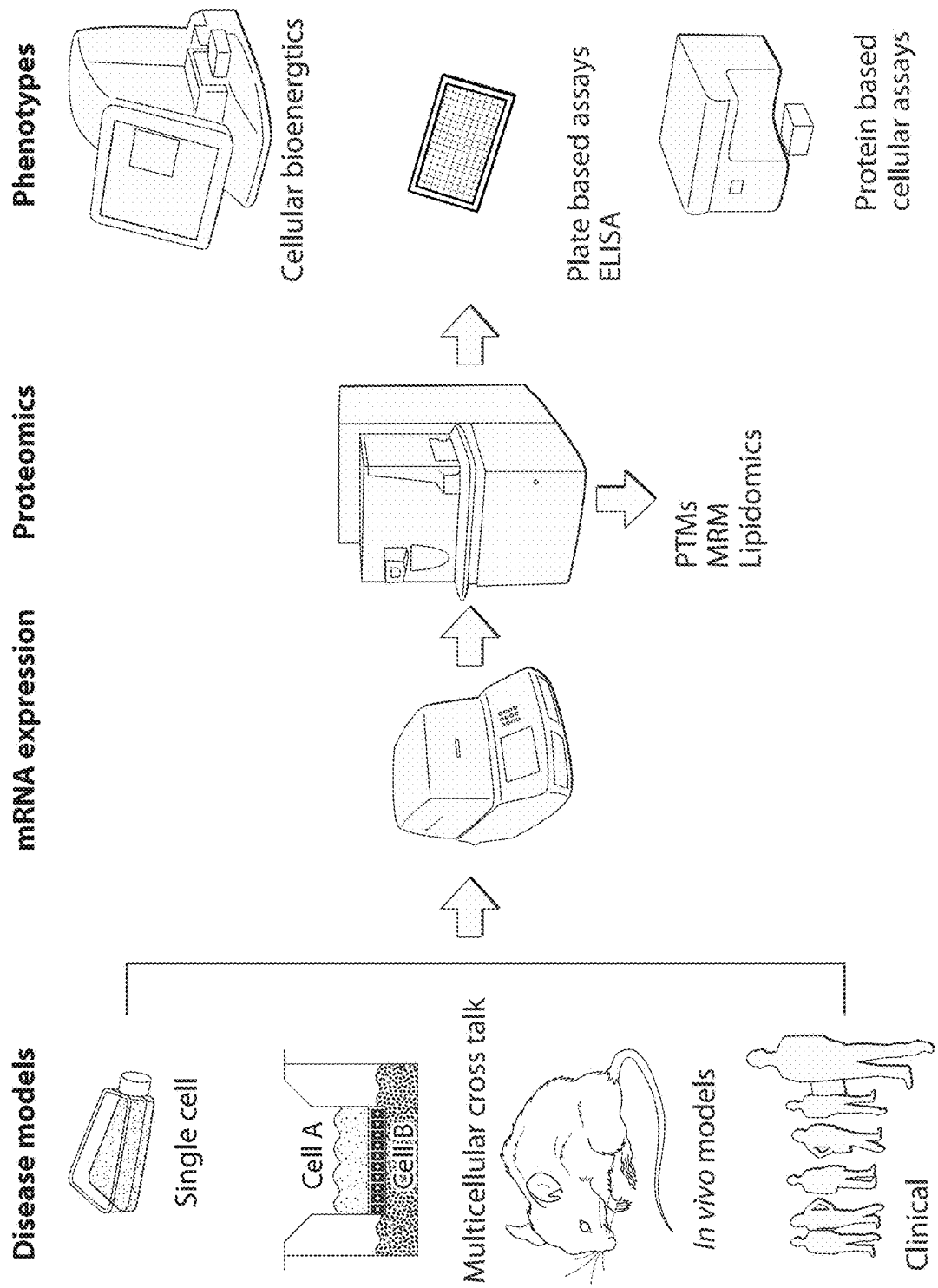
FIG. 6: Illustration of technologies employed in the platform technology.
Figure 7:
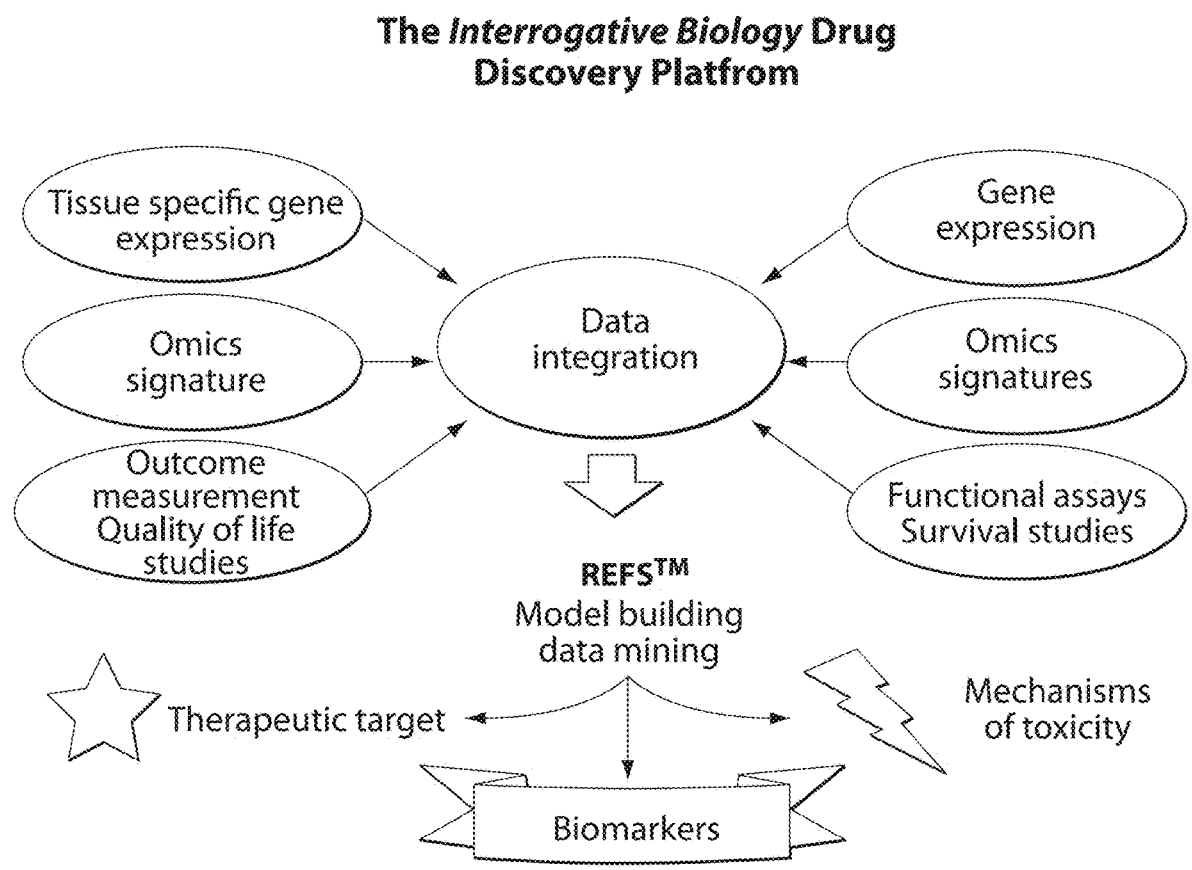
FIG. 7: Schematic representation of the components of the platform including data collection, data integration, and data mining.
Figure 8:
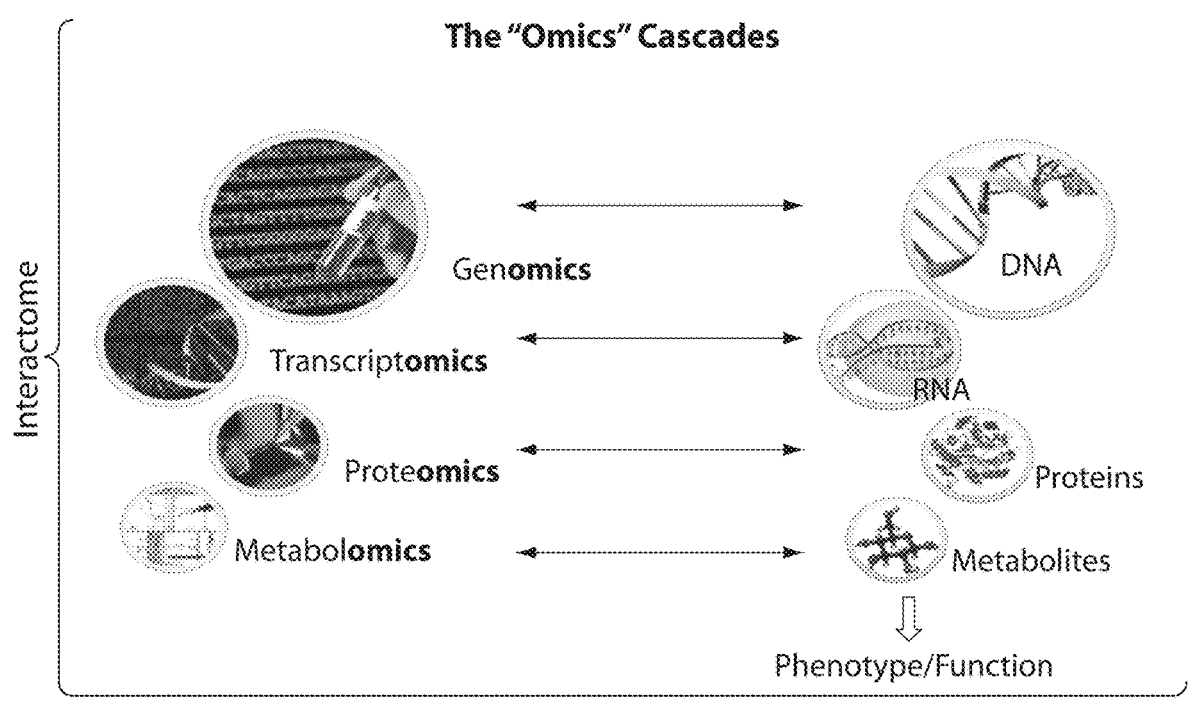
FIG. 8: Schematic representation of the systematic interrogation using MIMS and collection of response data from the "omics" cascade.

Illustrations of the interrogative biology platform and technologies employed in the platform are depicted in FIGS. 5 and 6. A schematic representation of the components of the platform including data collection, data integration, and data mining is depicted in FIG. 7. A schematic representation of a systematic interrogation using MIMS and collection of response data from the "omics" cascade is depicted in FIG. 8.

Figure 14:
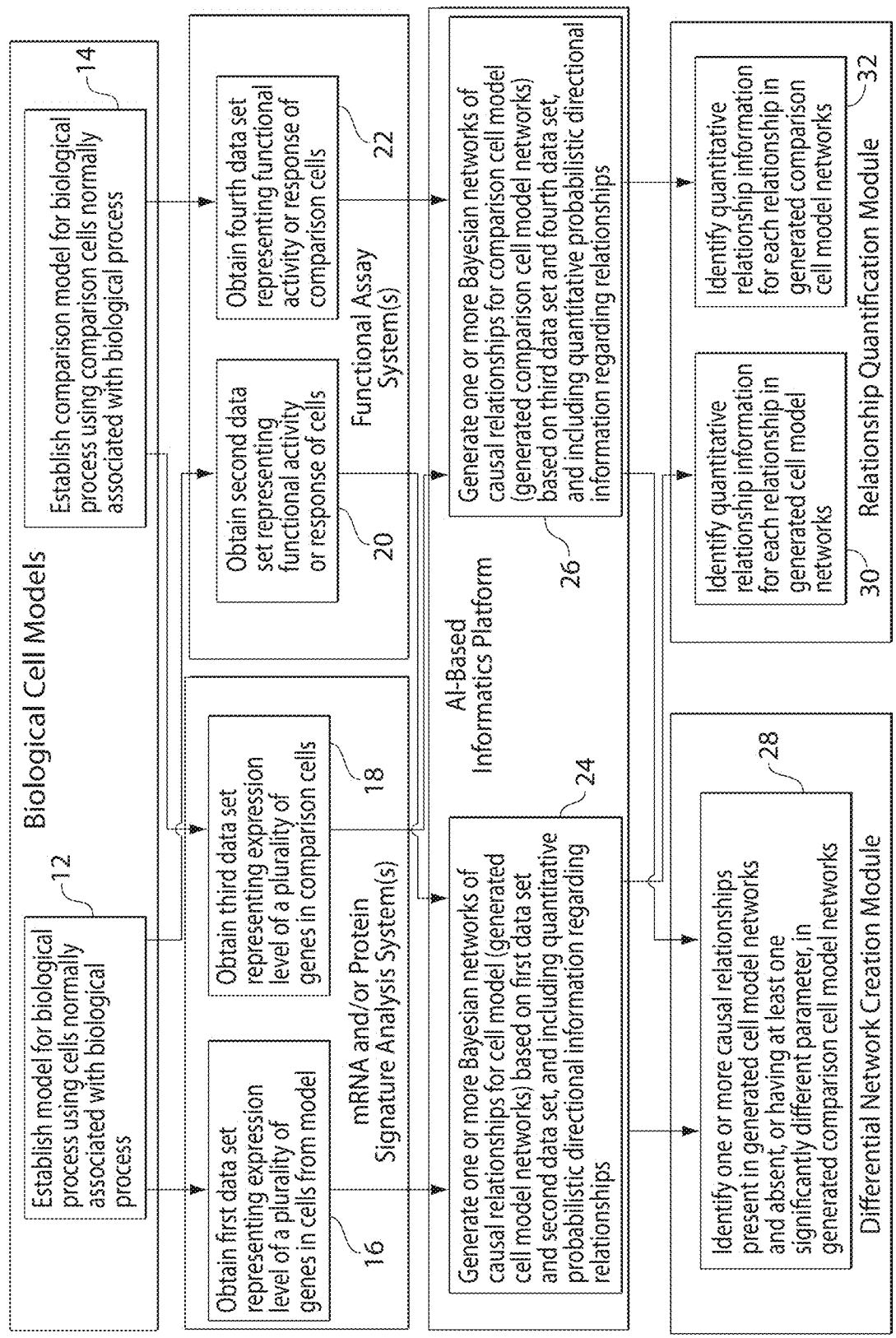
FIG. 14: High level flow chart of an exemplary method, in accordance with some embodiments.

FIG. 14 is a high level flow chart of an exemplary method 10, in which components of an exemplary system that may be used to perform the exemplary method are indicated. Initially, a model (e.g., an in vitro model) is established for a biological process (e.g., a drug-induced toxicity process) and/or components of the biological process (e.g., drug-induced toxicity physiology and pathophysiology) using cells normally associated with the process (step 12). For example, the cells may be human-derived cells that normally participate in the biological process (e.g., drug-induced toxicity). The cell model may include various cellular cues, conditions, and/or perturbations that are specific to the biological process (e.g., drug-induced toxicity). Ideally, the cell model represents various (drug-induced toxicity) states and flux components of the biological process (e.g., drug-induced toxicity), instead of a static assessment of the biological process. The comparison cell model may include control cells or normal cells, e.g., cells not exposed to a drug which induces toxicity. Additional description of the cell models appears below in sections III.A and IV.

A first data set is obtained from the cell model for the biological process (e.g. drug-induced toxicity), which includes information representing, by way of example, expression levels of a plurality of genes (e.g., mRNA and/or protein signatures) (step 16) using any known process or system (e.g., quantitative polymerase chain reaction (qPCR) & proteomics analysis tools such as Mass Spectrometry (MS)).

A third data set is obtained from the comparison cell model for the biological process (e.g. drug-induced toxicity) (step 18). The third data set includes information representing, e.g., expression levels of a plurality of genes in the comparison cells from the comparison cell model.

In certain embodiments of the methods of the invention, these first and third data sets are collectively referred to herein as a "first data set" that represents, e.g., expression levels of a plurality of genes in the cells (all cells including comparison cells) associated with the biological system (e.g. drug-induced toxicity model).

The first data set and third data set may be obtained from one or more mRNA and/or Protein Signature Analysis System(s). The mRNA and protein data in the first and third data sets may represent biological reactions to environment and/or perturbation. Where applicable and possible, lipidomics, metabolomics, and transcriptomics data may also be integrated into the first data set as supplemental or alternative measures for the biological process (e.g. drug-induced toxicity). The SNP analysis is another component that may be used at times in the process. It may be helpful for investigating, for example, whether a single-nucleotide polymorphism (SNP) or a specific mutation has any effect on the biological process (e.g. drug-induced toxicity). The data variables may be used to describe the biological process (e.g. drug-induced toxicity) either as a static "snapshot," or as a representation of a dynamic process. Additional description regarding obtaining information representing expression levels of a plurality of genes in cells appears below in section III.B.

A second data set is obtained from the cell model for the biological process (e.g. drug-induced toxicity), which includes information representing a functional activity or response of cells (step 20). Similarly, a fourth data set is obtained from the comparison cell model for the biological process (e.g. drug-induced toxicity), which includes information representing a functional activity or response of the comparison cells (step 22).

In certain embodiments of the methods of the invention, these second and fourth data sets are collectively referred to herein as a "second data set" that represents a functional activity or a cellular response of the cells (all cells including comparison cells) associated with the biological system (e.g. drug-induced toxicity).

One or more functional assay systems may be used to obtain information regarding the functional activity or response of cells or of comparison cells. The information regarding functional cellular responses to cues and perturbations may include, but is not limited to, bioenergetics profiling, cell proliferation, apoptosis, and organellar function. Functional models for processes and pathways (e.g., adenosine triphosphate (ATP), reactive oxygen species (ROS), oxidative phosphorylation (OXPHOS), Seahorse assays, etc.,) may be employed to obtain true genotype-phenotype association. Such functional activities can involve global enzyme activity, such as kinase activity, and/or effects of global enzyme activity, or the enzyme metabolites or substrates in the cells, e.g., the phosphor proteome of the cells. The functional activity or cellular responses represent the reaction of the cells in the biological process (or models thereof) in response to the corresponding state(s) of the mRNA/protein expression, and any other related applied conditions or perturbations. Additional information regarding obtaining information representing functional activity or response of cells is provided below in section III.B.

The method also includes generating computer-implemented models of the biological processes (e.g. drug-induced toxicity) in the cells and in the control cells. For example, one or more (e.g., an ensemble of) Bayesian networks of causal relationships between the expression level of the plurality of genes and the functional activity or cellular response may be generated for the cell model (the "generated cell model networks") from the first data set and the second data set (step 24). The generated cell model networks, individually or collectively, include quantitative probabilistic directional information regarding relationships. The generated cell model networks are not based on known biological relationships between gene expression and/or functional activity or cellular response, other than information from the first data set and second data set. The one or more generated cell model networks may collectively be referred to as a consensus cell model network.

One or more (e.g., an ensemble of) Bayesian networks of causal relationships between the expression level of the plurality of genes and the functional activity or cellular response may be generated for the comparison cell model (the "generated comparison cell model networks") from the first data set and the second data set (step 26). The generated comparison cell model networks, individually or collectively, include quantitative probabilistic directional information regarding relationships. The generated cell networks are not based on known biological relationships between gene expression and/or functional activity or cellular response, other than the information in the first data set and the second data set. The one or more generated comparison model networks may collectively be referred to as a consensus cell model network.

The generated cell model networks and the generated comparison cell model networks may be created using an artificial intelligence based (AI-based) informatics platform. Further details regarding the creation of the generated cell model networks, the creation of the generated comparison cell model networks and the AI-based informatics system appear below in section III.C and in the description of FIGS. 2A-3.

It should be noted that many different AI-based platforms or systems may be employed to generate the Bayesian networks of causal relationships including quantitative probabilistic directional information. Although certain examples described herein employ one specific commercially available system, i.e., REFS™ (Reverse Engineering/Forward Simulation) from GNS (Cambridge, Mass.), embodiments are not limited. AI-Based Systems or Platforms suitable to implement some embodiments employ mathematical algorithms to establish causal relationships among the input variables (e.g., the first and second data sets), based only on the input data without taking into consideration prior existing knowledge about any potential, established, and/or verified biological relationships.

For example, the REFS™ AI-based informatics platform utilizes experimentally derived raw (original) or minimally processed input biological data (e.g., genetic, genomic, epigenetic, proteomic, metabolomic, and clinical data), and rapidly performs trillions of calculations to determine how molecules interact with one another in a complete system. The REFS™ AI-based informatics platform performs a reverse engineering process aimed at creating an in silico computer-implemented cell model (e.g., generated cell model networks), based on the input data, that quantitatively represents the underlying biological system (e.g. drug-induced toxicity). Further, hypotheses about the underlying biological system can be developed and rapidly simulated based on the computer-implemented cell model, in order to obtain predictions, accompanied by associated confidence levels, regarding the hypotheses.

With this approach, biological systems are represented by quantitative computer-implemented cell models in which "interventions" are simulated to learn detailed mechanisms of the biological system (e.g., drug-induced toxicity), effective intervention strategies, and/or clinical biomarkers that determine which patients will respond to a given treatment regimen. Conventional bioinformatics and statistical approaches, as well as approaches based on the modeling of known biology, are typically unable to provide these types of insights.

Figure 18:
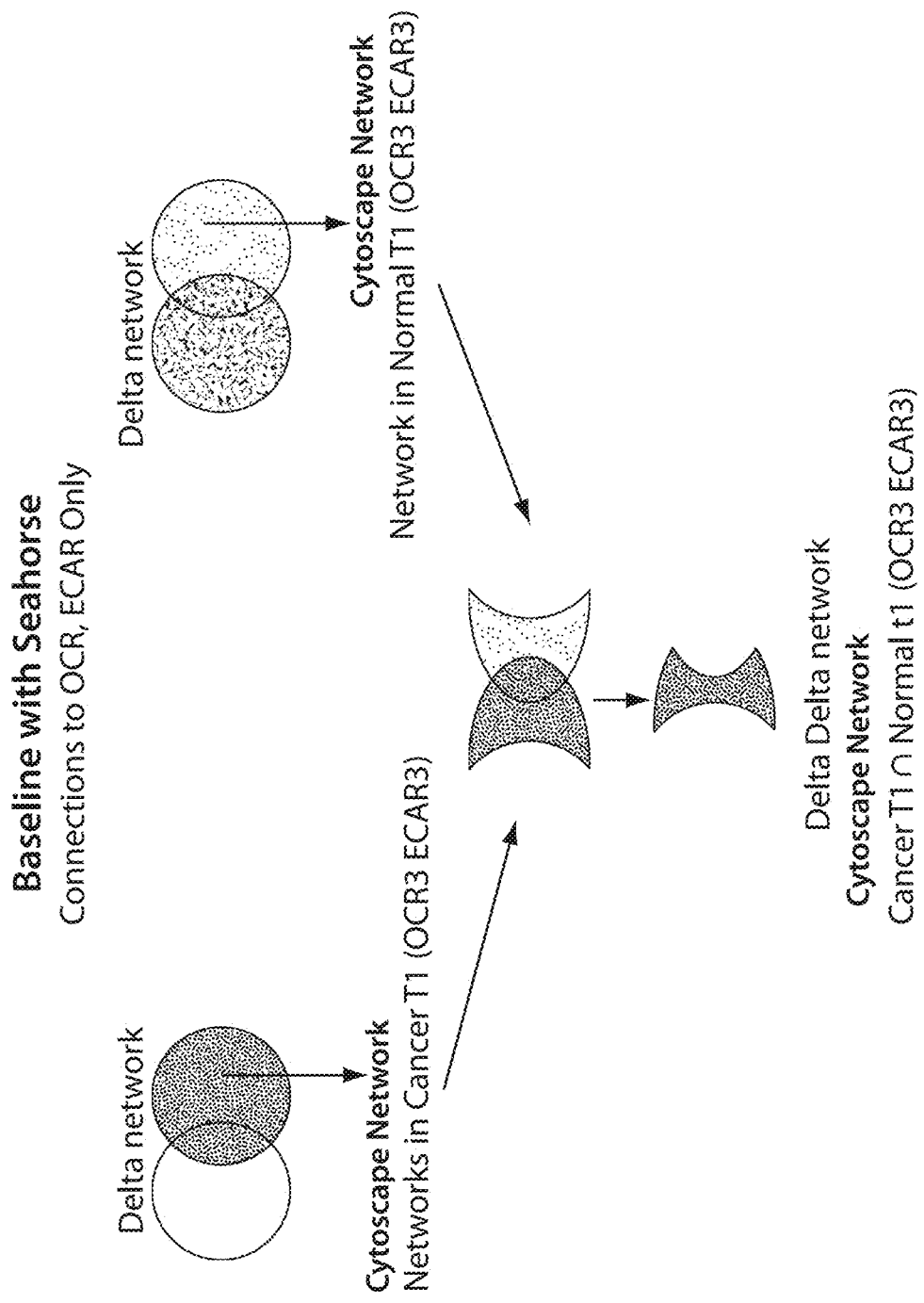
FIG. 18: Illustration of the mathematical approach towards generation of delta-delta networks.
Figure 19:
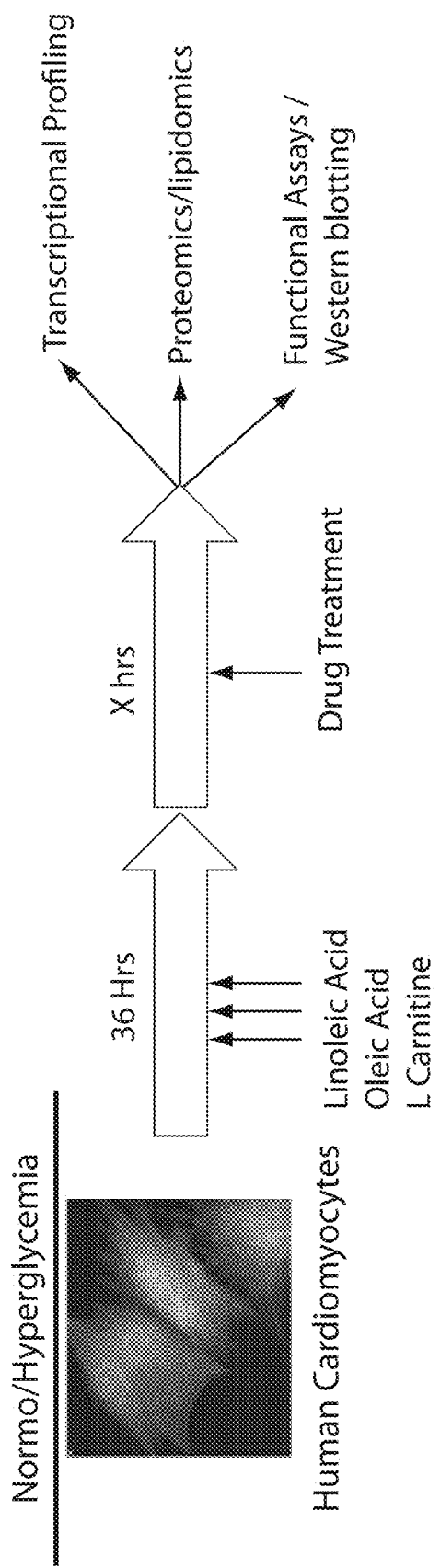
FIG. 19: A schematic representing experimental design and modeling parameters used to study drug induced toxicity in diabetic cardiomyocytes.

After the generated cell model networks and the generated comparison cell model networks are created, they are compared. One or more causal relationships present in at least some of the generated cell model networks, and absent from, or having at least one significantly different parameter in, the generated comparison cell model networks are identified (step 28). Such a comparison may result in the creation of a differential network. The comparison, identification, and/or differential (delta) network creation may be conducted using a differential network creation module, which is described in further detail below in section III.D and with respect to the description of FIG. 18.

In some embodiments, input data sets are from one cell type and one comparison cell type, which creates an ensemble of cell model networks based on the one cell type and another ensemble of comparison cell model networks based on the one comparison control cell type. A differential may be performed between the ensemble of networks of the one cell type and the ensemble of networks of the comparison cell type(s).

In other embodiments, input data sets are from multiple cell types (e.g., two or more cell types that are normally associated with the particular type of drug-induced toxicity and multiple comparison cell types (e.g., two or more normal cell types, e.g., same cells which are not exposed to the drug). An ensemble of cell model networks may be generated for each cell types and each comparison cell type individually, and/or data from the multiple cell types and the multiple comparison cell types may be combined into respective composite data sets. The composite data sets produce an ensemble of networks corresponding to the multiple cell types (composite data) and another ensemble of networks corresponding to the multiple comparison cell types (comparison composite data). A differential may be performed on the ensemble of networks for the composite data as compared to the ensemble of networks for the comparison composite data.

In some embodiments, a differential may be performed between two different differential networks. This output may be referred to as a delta-delta network, and is described below with respect to FIG. 18.

Quantitative relationship information may be identified for each relationship in the generated cell model networks (step 30). Similarly, quantitative relationship information for each relationship in the generated comparison cell model networks may be identified (step 32). The quantitative information regarding the relationship may include a direction indicating causality, a measure of the statistical uncertainty regarding the relationship (e.g., an Area Under the Curve (AUC) statistical measurement), and/or an expression of the quantitative magnitude of the strength of the relationship (e.g., a fold). The various relationships in the generated cell model networks may be profiled using the quantitative relationship information to explore each hub of activity in the networks as a potential therapeutic target and/or biomarker. Such profiling can be done entirely in silico based on the results from the generated cell model networks, without resorting to any actual wet-lab experiments.

In some embodiments, a hub of activity in the networks may be validated by employing molecular and cellular techniques. Such post-informatic validation of output with wet-lab cell based experiments need not be performed, but it may help to create a full-circle of interrogation. FIG. 15 schematically depicts a simplified high level representation of the functionality of an exemplary AI-based informatics system (e.g., REFS™ AI-based informatics system) and interactions between the AI-based system and other elements or portions of an interrogative biology platform ("the Platform"). In FIG. 15A, various data sets obtained from a model for a biological process (e.g., a drug-induced toxicity model), such as drug dosage, treatment dosage, protein expression, mRNA expression, lipid levels, metabolite levels, kinase activity and any of many other associated functional measures (such as OCR, ECAR) are fed into an AI-based system. As shown in FIG. 15B, from the input data sets, the AI-system creates a library of "network fragments" that includes variables (e.g., proteins, lipids, kinases and metabolites) that drive molecular mechanisms in the biological process (e.g., drug-induced toxicity), in a process referred to as Bayesian Fragment Enumeration (FIG. 15B).

In FIG. 15C, the AI-based system selects a subset of the network fragments in the library and constructs an initial trial network from the fragments. The AI-based system also selects a different subset of the network fragments in the library to construct another initial trial network. Eventually an ensemble of initial trial networks are created (e.g., 1000 networks) from different subsets of network fragments in the library. This process may be termed parallel ensemble sampling. Each trial network in the ensemble is evolved or optimized by adding, subtracting and/or substitution additional network fragments from the library. If additional data is obtained, the additional data may be incorporated into the network fragments in the library and may be incorporated into the ensemble of trial networks through the evolution of each trial network. After completion of the optimization/evolution process, the ensemble of trial networks may be described as the generated cell model networks.

As shown in FIG. 15D, the ensemble of generated cell model networks may be used to simulate the behavior of the biological system (e.g. drug-induced toxicity). The simulation may be used to predict behavior of the biological system (e.g. drug-induced toxicity) to changes in conditions, which may be experimentally verified using wet-lab cell-based, or animal-based, experiments. Also, quantitative parameters of relationships in the generated cell model networks may be extracted using the simulation functionality by applying simulated perturbations to each node individually while observing the effects on the other nodes in the generated cell model networks. Further detail is provided below in section III.C.

The automated reverse engineering process of the AI-based informatics system, which is depicted in FIGS. 2A-2D, creates an ensemble of generated cell model networks that is an unbiased and systematic computer-based model of the cells.

The reverse engineering determines the probabilistic directional network connections between the molecular measurements in the data, and the phenotypic outcomes of interest. The variation in the molecular measurements enables learning of the probabilistic cause and effect relationships between these entities and changes in endpoints. The machine learning nature of the platform also enables cross training and predictions based on a data set that is constantly evolving.

The network connections between the molecular measurements in the data are "probabilistic," partly because the connection may be based on correlations between the observed data sets "learned" by the computer algorithm. For example, if the expression level of protein X and that of protein Y are positively or negatively correlated, based on statistical analysis of the data set, a causal relationship may be assigned to establish a network connection between proteins X and Y. The reliability of such a putative causal relationship may be further defined by a likelihood of the connection, which can be measured by p-value (e.g., p<0.1, 0.05, 0.01, etc).

The network connections between the molecular measurements in the data are "directional," partly because the network connections between the molecular measurements, as determined by the reverse-engineering process, reflects the cause and effect of the relationship between the connected gene/protein, such that raising the expression level of one protein may cause the expression level of the other to rise or fall, depending on whether the connection is stimulatory or inhibitory.

The network connections between the molecular measurements in the data are "quantitative," partly because the network connections between the molecular measurements, as determined by the process, may be simulated in silico, based on the existing data set and the probabilistic measures associated therewith. For example, in the established network connections between the molecular measurements, it may be possible to theoretically increase or decrease (e.g., by 1, 2, 3, 5, 10, 20, 30, 50,100-fold or more) the expression level of a given protein (or a "node" in the network), and quantitatively simulate its effects on other connected proteins in the network.

The network connections between the molecular measurements in the data are "unbiased," at least partly because no data points are statistically or artificially cut-off, and partly because the network connections are based on input data alone, without referring to pre-existing knowledge about the biological process in question.

The network connections between the molecular measurements in the data are "systemic" and (unbiased), partly because all potential connections among all input variables have been systemically explored, for example, in a pair-wise fashion. The reliance on computing power to execute such systemic probing exponentially increases as the number of input variables increases.

In general, an ensemble of ~1,000 networks is usually sufficient to predict probabilistic causal quantitative relationships among all of the measured entities. The ensemble of networks captures uncertainty in the data and enables the calculation of confidence metrics for each model prediction. Predictions generated using the ensemble of networks together, where differences in the predictions from individual networks in the ensemble represent the degree of uncertainty in the prediction. This feature enables the assignment of confidence metrics for predictions of clinical response generated from the model.

Once the models are reverse-engineered, further simulation queries may be conducted on the ensemble of models to determine key molecular drivers for the biological process in question, such as a drug-induced toxicity condition.

Figure 9:
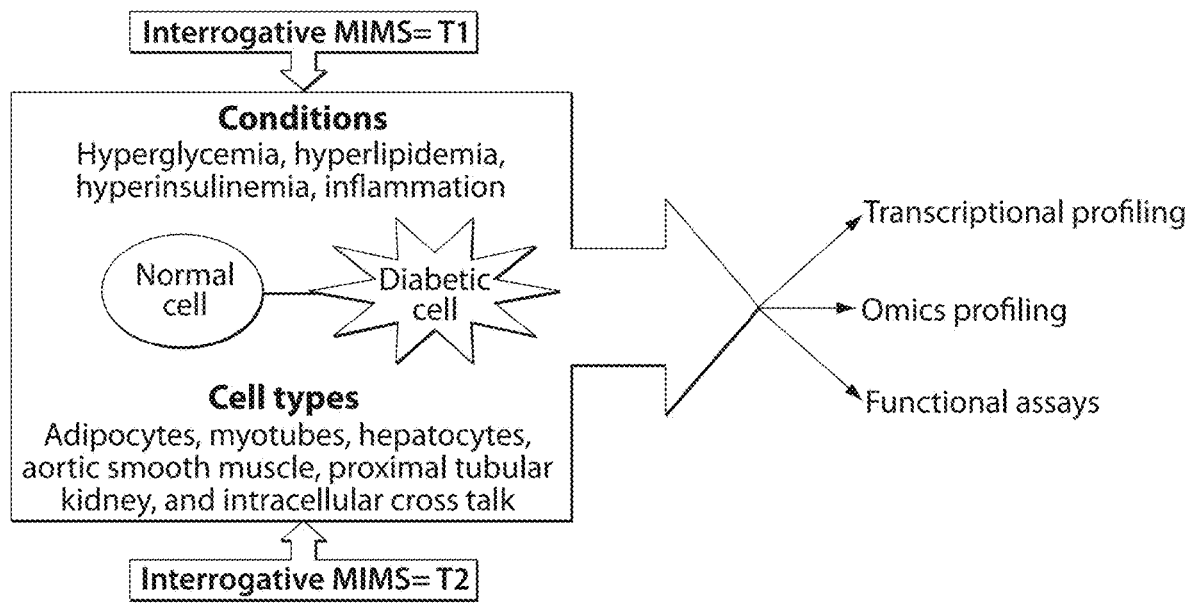
FIG. 9: Sketch of the components employed to build the in vitro models representing normal and diabetic states.
Figure 10:
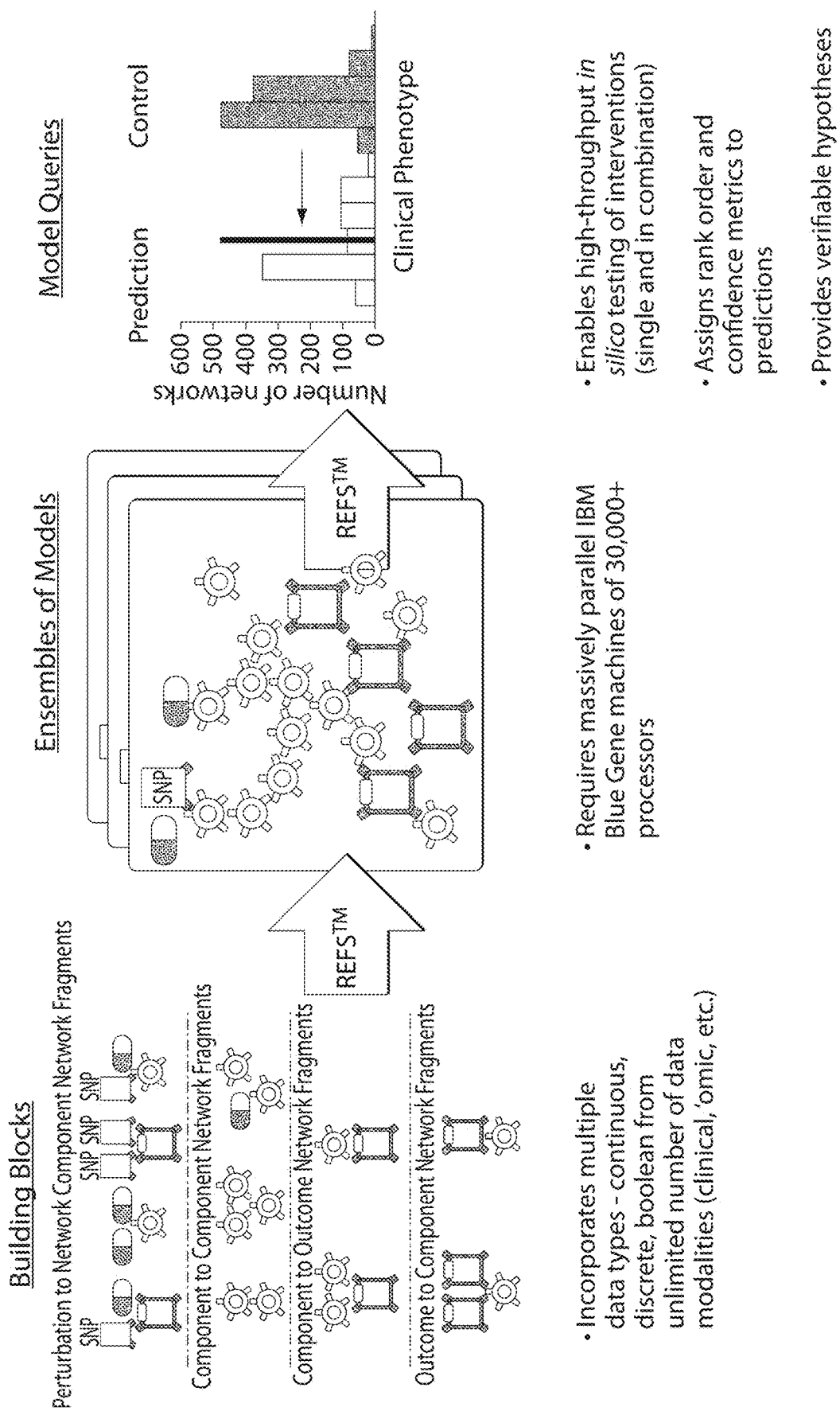
FIG. 10: Schematic representation of the informatics platform REFS™ used to generate causal networks of the protein as they relate to disease pathophysiology.
Figure 11:
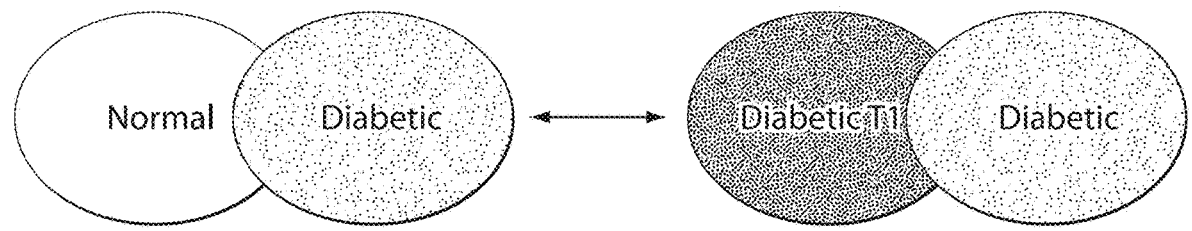
FIG. 11: Schematic representation of the approach towards generation of differential network in diabetic versus normal states and diabetic nodes that are restored to normal states by treatment with MIMS.
Figure 12:
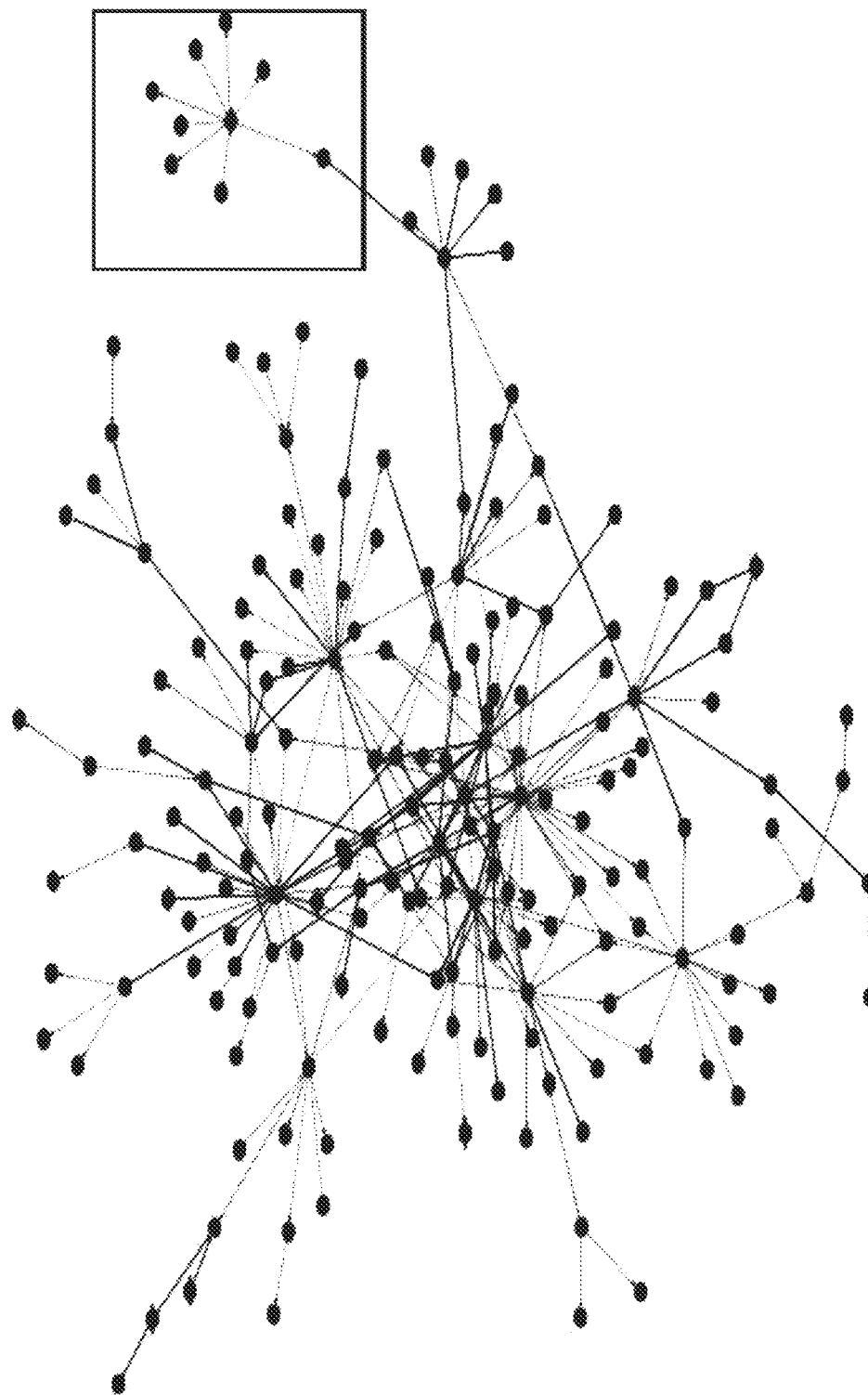
FIG. 12: A representative differential network in diabetic versus normal states.
Figure 13:
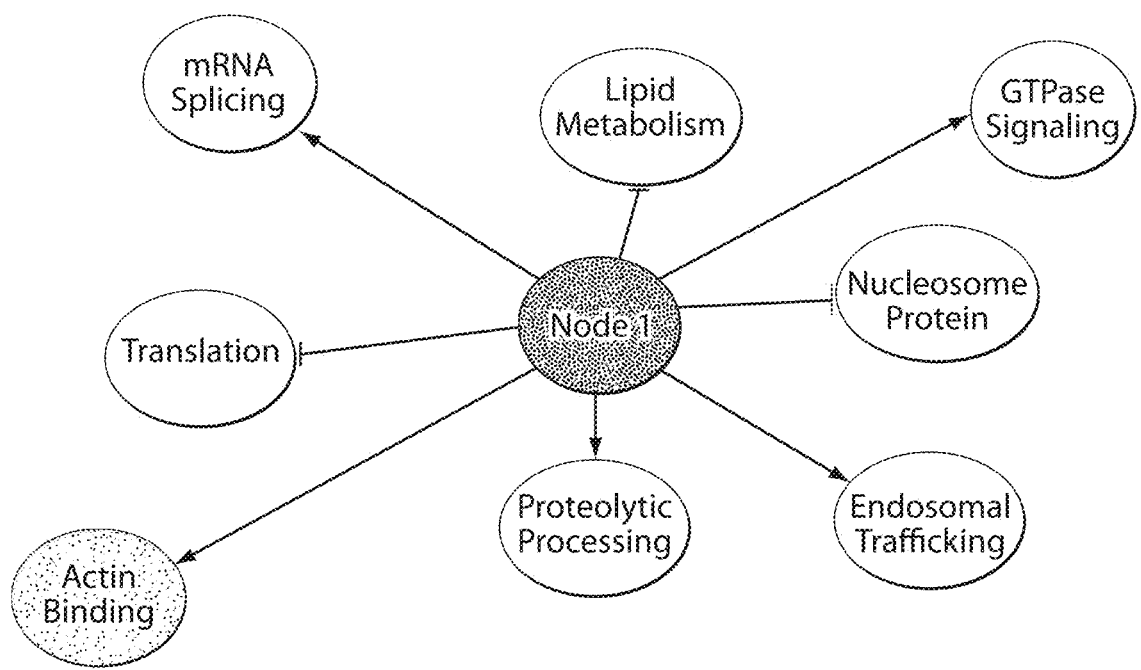
FIG. 13: A schematic representation of a node and associated edges of interest (Nodelin the center). The cellular functionality associated with each edge is represented.

Sketch of components employed to build exemplary In vitro models representing normal and diabetic statesis is depicted in FIG. 9. Schematic representation of an exemplary informatics platform REFS™ used to generate causal networks of the protein as they relate to disease pathophysiology is depicted in FIG. 10. Schematic representation of exemplary approach towards generation of differential network in diabetic versus normal states and diabetic nodes that are restored to normal states by treatment with MIMS is depicted in FIG. 11. A representative differential network in diabetic versus normal states is depicted in FIG. 12. A schematic representation of a node and associated edges of interest (Node 1 in the center) and the cellular functionality associated with each edge is depicted in FIG. 13.

The invention having been generally described above, the sections below provide more detailed description for various aspects or elements of the general invention, in conjunction with one or more specific biological systems (e.g. drug-induced toxicity) that can be analyzed using the methods herein. It should be noted, however, the specific drug-induced toxicity used for illustration purpose below are not limiting. To the contrary, it is intended that other distinct drug-induced toxicities, including any alternatives, modifications, and equivalents thereof, may be analyzed similarly using the subject Platform technology.

II. Definitions

As used herein, certain terms intended to be specifically defined, but are not already defined in other sections of the specification, are defined herein.

The articles "a" and "an" are used herein to refer to one or to more than one (i.e., to at least one) of the grammatical object of the article. By way of example, "an element" means one element or more than one element.

The term "including" is used herein to mean, and is used interchangeably with, the phrase "including but not limited to."

The term "or" is used herein to mean, and is used interchangeably with, the term "and/or," unless context clearly indicates otherwise.

The term "such as" is used herein to mean, and is used interchangeably, with the phrase "such as but not limited to."

"Metabolic pathway" refers to a sequence of enzyme-mediated reactions that transform one compound to another and provide intermediates and energy for cellular functions. The metabolic pathway can be linear or cyclic or branched.

"Metabolic state" refers to the molecular content of a particular cellular, multicellular or tissue environment at a given point in time as measured by various chemical and biological indicators as they relate to a state of health or disease.

The term "microarray" refers to an array of distinct polynucleotides, oligonucleotides, polypeptides (e.g., antibodies) or peptides synthesized on a substrate, such as paper, nylon or other type of membrane, filter, chip, glass slide, or any other suitable solid support.

The terms "disorders" and "diseases" are used inclusively and refer to any deviation from the normal structure or function of any part, organ or system of the body (or any combination thereof). A specific disease is manifested by characteristic symptoms and signs, including biological, chemical and physical changes, and is often associated with a variety of other factors including, but not limited to, demographic, environmental, employment, genetic and medically historical factors. Certain characteristic signs, symptoms, and related factors can be quantitated through a variety of methods to yield important diagnostic information.

The term "drug-induced toxicity" includes but is not limited to cardiotoxicity, hepatotoxicity, nephrotoxicity, neurotoxicity, renaltoxicity or myotoxicity.

The term "cardiotoxicity" refers to a broad range of adverse effects on heart function induced by therapeutic molecules. It may emerge early in pre-clinical studies or become apparent later in the clinical setting. Cardiovascular toxicity described herein includes, but is not limited to, any one or more of increased QT duration, arrhythmias, myocardial ischemia, hypertension and thromboembolic complications, myocardial dysfunction, cardiomyopathy and heart failure, atrial fibrillation, cardiomyopathy and heart failure, heart failure and LV dysfunction, atrial flutter and fibrillation, and, heart valve damage and heart failure.

The term "expression" includes the process by which a polypeptide is produced from polynucleotides, such as DNA. The process may involves the transcription of a gene into mRNA and the translation of this mRNA into a polypeptide. Depending on the context in which it is used, "expression" may refer to the production of RNA, protein or both.

The terms "level of expression of a gene" or "gene expression level" refer to the level of mRNA, as well as pre-mRNA nascent transcript(s), transcript processing intermediates, mature mRNA(s) and degradation products, or the level of protein, encoded by the gene in the cell.

The term "modulation" refers to upregulation (i.e., activation or stimulation), downregulation (i.e., inhibition or suppression) of a response, or the two in combination or apart. A "modulator" is a compound or molecule that modulates, and may be, e.g., an agonist, antagonist, activator, stimulator, suppressor, or inhibitor.

"Normal level" of a protein, a lipid, a transcript, a metabolite, or gene expression refers to the level of the protein, lipid, transcript, metabolite, or gene expression prior to contacting the cells with the drug with the potentially toxic drug. A "normal level" can be determined in cells grown under various conditions, e.g., hyperglycemia, hypoxia, if the toxicity of the drug is to be tested under the same conditions.

"Modulated level" refers to a changed value relative to the normal level which is based on historical normal control samples or preferably normal control samples tested in the same experiment. The specific "normal" value will depend, for example, on the type of assay (e.g., ELISA, enzyme activity, immunohistochemistry, PCR), the sample to be tested (e.g., cell type and culture conditions), and other considerations known to those of skill in the art. Control samples can be used to define cut-offs between normal and abnormal.

A drug is considered to be toxic if treatment of cells with the drug results in a statistically significant change in the level of at least one marker relative to a "normal" or appropriate control level. It is understood that not all concentrations of a drug must result in a statistically significant change in the level of the at least one marker. In a preferred embodiment, a drug is considered to potentially have toxicities if a therapeutically relevant concentration of the drug results in a statistically significant change in the level of at least one marker.

A "rescue agent" is considered to be effective in reducing toxicity if the level of the marker is modulated in a statistically significant manner towards the marker level in the "normal cells" when the rescue agent is present at a therapeutically relevant concentration. In a preferred embodiment, the rescue agent returns the marker to a level that is not statistically different from the level of the marker in the control cells.

The term "control level" refers to an accepted or predetermined level of a marker, or preferably the marker level determined in a control sample tested in parallel with the test sample, which is used to compare with the level of a marker in a sample derived from cells not treated with the potentially toxic drug or rescue agent. A "control level" is obtained from cells that are cultured under the same conditions, e.g., hypoxia, hyperglycemia, lactic acid, etc.

The term "Trolamine," as used herein, refers to Trolamine NF, Triethanolamine, TEALAN®, TEAlan 99%, Triethanolamine, 99%, Triethanolamine, NF or Triethanolamine, 99%, NF. These terms may be used interchangeably herein.

The term "genome" refers to the entirety of a biological entity's (cell, tissue, organ, system, organism) genetic information. It is encoded either in DNA or RNA (in certain viruses, for example). The genome includes both the genes and the non-coding sequences of the DNA.

The term "proteome" refers to the entire set of proteins expressed by a genome, a cell, a tissue, or an organism at a given time. More specifically, it may refer to the entire set of expressed proteins in a given type of cells or an organism at a given time under defined conditions. Proteome may include protein variants due to, for example, alternative splicing of genes and/or post-translational modifications (such as glycosylation or phosphorylation).

The term "transcriptome" refers to the entire set of transcribed RNA molecules, including mRNA, rRNA, tRNA, microRNA and other non-coding RNA produced in one or a population of cells at a given time. The term can be applied to the total set of transcripts in a given organism, or to the specific subset of transcripts present in a particular cell type. Unlike the genome, which is roughly fixed for a given cell line (excluding mutations), the transcriptome can vary with external environmental conditions. Because it includes all mRNA transcripts in the cell, the transcriptome reflects the genes that are being actively expressed at any given time, with the exception of mRNA degradation phenomena such as transcriptional attenuation.

The study of transcriptomics, also referred to as expression profiling, examines the expression level of mRNAs in a given cell population, often using high-throughput techniques based on DNA microarray technology.

The term "metabolome" refers to the complete set of small-molecule metabolites (such as metabolic intermediates, hormones and other signalling molecules, and secondary metabolites) to be found within a biological sample, such as a single organism, at a given time under a given condition. The metabolome is dynamic, and may change from second to second.

The term "lipidome" refers to the complete set of lipids to be found within a biological sample, such as a single organism, at a given time under a given condition. The lipidome is dynamic, and may change from second to second.

The term "interactome" refers to the whole set of molecular interactions in a biological system under study (e.g., cells). It can be displayed as a directed graph. Molecular interactions can occur between molecules belonging to different biochemical families (proteins, nucleic acids, lipids, carbohydrates, etc.) and also within a given family. When spoken in terms of proteomics, interactome refers to protein-protein interaction network (PPI), or protein interaction network (PIN). Another extensively studied type of interactome is the protein-DNA interactome (network formed by transcription factors (and DNA or chromatin regulatory proteins) and their target genes.

The term "cellular output" includes a collection of parameters, preferably measurable parameters, relating to cellular status, including (without limiting): level of transcription for one or more genes (e.g., measurable by RT-PCR, qPCR, microarray, etc.), level of expression for one or more proteins (e.g., measurable by mass spectrometry or Western blot), absolute activity (e.g., measurable as substrate conversion rates) or relative activity (e.g., measurable as a % value compared to maximum activity) of one or more enzymes or proteins, level of one or more metabolites or intermediates, level of oxidative phosphorylation (e.g., measurable by Oxygen Consumption Rate or OCR), level of glycolysis (e.g., measurable by Extra Cellular Acidification Rate or ECAR), extent of ligand-target binding or interaction, activity of extracellular secreted molecules, etc. The cellular output may include data for a pre-determined number of target genes or proteins, etc., or may include a global assessment for all detectable genes or proteins. For example, mass spectrometry may be used to identify and/or quantitate all detectable proteins expressed in a given sample or cell population, without prior knowledge as to whether any specific protein may be expressed in the sample or cell population.

As used herein, a "cell system" includes a population of homogeneous or heterogeneous cells. The cells within the system may be growing in vivo, under the natural or physiological environment, or may be growing in vitro in, for example, controlled tissue culture environments. The cells within the system may be relatively homogeneous (e.g., no less than 70%, 80%, 90%, 95%, 99%, 99.5%, 99.9% homogeneous), or may contain two or more cell types, such as cell types usually found to grow in close proximity in vivo, or cell types that may interact with one another in vivo through, e.g., paracrine or other long distance inter-cellular communication. The cells within the cell system may be derived from established cell lines, including cancer cell lines, immortal cell lines, or normal cell lines, or may be primary cells or cells freshly isolated from live tissues or organs.

Cells in the cell system are typically in contact with a "cellular environment" that may provide nutrients, gases (oxygen or $CO_2$, etc.), chemicals, or proteinaceous/non-proteinaceous stimulants that may define the conditions that affect cellular behavior. The cellular environment may be a chemical media with defined chemical components and/or less well-defined tissue extracts or serum components, and may include a specific pH, $CO_2$ content, pressure, and temperature under which the cells grow. Alternatively, the cellular environment may be the natural or physiological environment found in vivo for the specific cell system.

In certain embodiments, a cell environment comprises conditions that simulate an aspect of a biological system or process, e.g., simulate a disease state, process, or environment. Such culture conditions include, for example, hyperglycemia, hypoxia, or lactic-rich conditions. Numerous other such conditions are described herein.

In certain embodiments, a cellular environment for a specific cell system also include certain cell surface features of the cell system, such as the types of receptors or ligands on the cell surface and their respective activities, the structure of carbohydrate or lipid molecules, membrane polarity or fluidity, status of clustering of certain membrane proteins, etc. These cell surface features may affect the function of nearby cells, such as cells belonging to a different cell system. In certain other embodiments, however, the cellular environment of a cell system does not include cell surface features of the cell system.

The cellular environment may be altered to become a "modified cellular environment." Alterations may include changes (e.g., increase or decrease) in any one or more component found in the cellular environment, including addition of one or more "external stimulus component" to the cellular environment. The environmental perturbation or external stimulus component may be endogenous to the cellular environment (e.g., the cellular environment contains some levels of the stimulant, and more of the same is added to increase its level), or may be exogenous to the cellular environment (e.g., the stimulant is largely absent from the cellular environment prior to the alteration). The cellular environment may further be altered by secondary changes resulting from adding the external stimulus component, since the external stimulus component may change the cellular output of the cell system, including molecules secreted into the cellular environment by the cell system.

As used herein, "external stimulus component", also referred to herein as "environmental perturbation", include any external physical and/or chemical stimulus that may affect cellular function. This may include any large or small organic or inorganic molecules, natural or synthetic chemicals, temperature shift, pH change, radiation, light (UVA, UVB etc.), microwave, sonic wave, electrical current, modulated or unmodulated magnetic fields, etc.

The term "Multidimensional Intracellular Molecule (MIM)", is an isolated version or synthetically produced version of an endogenous molecule that is naturally produced by the body and/or is present in at least one cell of a human. A MIM is capable of entering a cell and the entry into the cell includes complete or partial entry into the cell as long as the biologically active portion of the molecule wholly enters the cell. MIMs are capable of inducing a signal transduction and/or gene expression mechanism within a cell. MIMs are multidimensional because the molecules have both a therapeutic and a carrier, e.g., drug delivery, effect. MIMs also are multidimensional because the molecules act one way in a disease state and a different way in a normal state. For example, in the case of CoQ-10, administration of CoQ-10 to a melanoma cell in the presence of VEGF leads to a decreased level of Bcl2 which, in turn, leads to a decreased oncogenic potential for the melanoma cell. In contrast, in a normal fibroblast, co-administration of CoQ-10 and VEFG has no effect on the levels of Bcl2.

In one embodiment, a MIM is also an epi-shifter In another embodiment, a MIM is not an epi-shifter. In another embodiment, a MIM is characterized by one or more of the foregoing functions. In another embodiment, a MIM is characterized by two or more of the foregoing functions. In a further embodiment, a MIM is characterized by three or more of the foregoing functions. In yet another embodiment, a MIM is characterized by all of the foregoing functions. The skilled artisan will appreciate that a MIM of the invention is also intended to encompass a mixture of two or more endogenous molecules, wherein the mixture is characterized by one or more of the foregoing functions. The endogenous molecules in the mixture are present at a ratio such that the mixture functions as a MIM.

MIMs can be lipid based or non-lipid based molecules. Examples of MIMs include, but are not limited to, CoQ10, acetyl Co-A, palmityl Co-A, L-carnitine, amino acids such as, for example, tyrosine, phenylalanine, and cysteine. In one embodiment, the MIM is a small molecule. In one embodiment of the invention, the MIM is not CoQ10. MIMs can be routinely identified by one of skill in the art using any of the assays described in detail herein. MIMs are described in further detail in U.S. Ser. No. 12/777,902 (US 2011-0110914), the entire contents of which are expressly incorporated herein by reference.

As used herein, an "epimetabolic shifter" (epi-shifter) is a molecule that modulates the metabolic shift from a healthy (or normal) state to a disease state and vice versa, thereby maintaining or reestablishing cellular, tissue, organ, system and/or host health in a human. Epi-shifters are capable of effectuating normalization in a tissue microenvironment. For example, an epi-shifter includes any molecule which is capable, when added to or depleted from a cell, of affecting the microenvironment (e.g., the metabolic state) of a cell. The skilled artisan will appreciate that an epi-shifter of the invention is also intended to encompass a mixture of two or more molecules, wherein the mixture is characterized by one or more of the foregoing functions. The molecules in the mixture are present at a ratio such that the mixture functions as an epi-shifter. Examples of epi-shifters include, but are not limited to, CoQ-10; vitamin D3; ECM components such as fibronectin; immunomodulators, such as TNFa or any of the interleukins, e.g., IL-5, IL-12, IL-23; angiogenic factors; and apoptotic factors.

In one embodiment, the epi-shifter also is a MIM. In one embodiment, the epi-shifter is not CoQ10. Epi-shifters can be routinely identified by one of skill in the art using any of the assays described in detail herein. Epi-shifters are described in further detail in U.S. Ser. No. 12/777,902 (US 2011-0110914), the entire contents of which are expressly incorporated herein by reference.

Other terms not explicitly defined in the instant application have meaning as would have been understood by one of ordinary skill in the art.

III. Exemplary Steps and Components of the Platform Technology

For illustration purpose only, the following steps of the subject Platform Technology may be described herein below as an exemplary utility for integrating data obtained from a custom built drug-induced toxicity model, and for identifying novel proteins/pathways driving the pathogenesis of drug-induced toxicity. Relational maps resulting from this analysis provides drug-induced toxicity treatment targets, as well as diagnostic/prognostic markers associated with drug-induced toxicity. However, the subject Platform Technology has general applicability for any drug-induced toxicity, and is not limited to any particular drug-induced toxicity or other specific drug-induced toxicity models.

In addition, although the description below is presented in some portions as discrete steps, it is for illustration purpose and simplicity, and thus, in reality, it does not imply such a rigid order and/or demarcation of steps. Moreover, the steps of the invention may be performed separately, and the invention provided herein is intended to encompass each of the individual steps separately, as well as combinations of one or more (e.g., any one, two, three, four, five, six or all seven steps) steps of the subject Platform Technology, which may be carried out independently of the remaining steps.

The invention also is intended to include all aspects of the Drug-induced Toxicity Platform Technology as separate components and embodiments of the invention. For example, the generated data sets are intended to be embodiments of the invention. As further examples, the generated causal relationship networks, generated consensus causal relationship networks, and/or generated simulated causal relationship networks, are also intended to be embodiments of the invention. The causal relationships identified as being unique in the drug-induced toxicity system are intended to be embodiments of the invention. Further, the custom built models for a particular drug-induced toxicity system are also intended to be embodiments of the invention. For example, custom built models for a drug-induced toxicity state or process, such as, e.g., a custom built model for toxicity (e.g., cardiotoxicity) of a drug, are also intended to be embodiments of the invention.

A. Custom Model Building

The first step in the Platform Technology is the establishment of a model for a drug-induced toxicity system or process. An example of a drug-induced toxicity system or process is cardiotoxicity. As any other complicated biological process or system, cardiotoxicity is a complicated pathological condition characterized by multiple unique aspects. For example, chronic imbalance in uptake, utilization, organellar biogenesis and secretion in non-adipose tissue (heart and liver) is thought to be at the center of mitochondrial damage and dysfunction and a key player in drug induced cardiotoxicity. To this end, a custom cardiotoxicity model comprising diabetic and normal cardiomyocytes may be established to simulate the environment of cardiotoxicity, e.g., by creating cell culture conditions closely approximating the conditions of a cardiac cell experiencing cardiotoxicity. One or more relevant types of cells may be used in the model, such as, for example, cardiomyocytes, diabetic cardiomyocytes, hepatocytes, kidney cells, neural cells, renal cells, or myoblasts.

One such "environment", or growth stress condition, is hypoxia, a condition typically found in a number of disease states and in late stage diabetes or in cardiovascular disease due to ischemia and poor circulation. Hypoxia can be induced in cells in cells using art-recognized methods. For example, hypoxia can be induced by placing cell systems in a Modular Incubator Chamber (MIC-101, Billups-Rothenberg Inc. Del Mar, Calif.), which can be flooded with an industrial gas mix containing 5% $CO_2$, 2% $O_2$ and 93% nitrogen. Effects can be measured after a pre-determined period, e.g., at 24 hours after hypoxia treatment, with and without additional external stimulus components (e.g., CoQ10 at 0, 50, or 100 µM).

Likewise, lactic acid treatment of cells mimics a cellular environment where glycolysis activity is high. Lactic acid induced stress can be investigated at a final lactic acid concentration of about 12.5 mM at a pre-determined time, e.g., at 24 hours, with or without additional external stimulus components (e.g., CoQ10 at 0, 50, or 100 µM).

Hyperglycemia is normally a condition found in diabetes. As high glucose is known to alter cellular metabolism, agents for the treatment of diabetes can be tested in cells cultured under hyperglycemic conditions. Exposing subject cells to a typical hyperglycemic condition may include adding 10% culture grade glucose to suitable media, such that the final concentration of glucose in the media is about 22 mM. However, as subjects with type 2 diabetes, are frequently overweight or obese, they are frequently treated for other diseases or conditions with other agents, e.g., arthritis with anti-inflammatory agents, cardiovascular disease with cholesterol lowering, blood pressure lowering, or blood thinning agents. Thus, custom built models can be used to assess drug toxicity in normal subjects as compared to subjects to be treated for a first condition with a first agent that also have other diseases or conditions. For example, cells not exposed or exposed to hyperglycemic conditions can be tested together to detect differential toxicities of agents in subjects with or without diabetes.

Hyperlipidemia is a condition found, for example, in obesity and cardiovascular disease. Hyperlipidemia is also a condition which mimics one aspect of cardiotoxicity. The hyperlipidemic conditions can be provided by culturing cells in media containing 0.15 mM sodium palmitate.

Individual conditions reflecting different aspects of toxicity may be investigated separately in the custom built toxicity model, and/or may be combined together. In one embodiment, combinations of at least 2, 3, 4, 5, 6, 7, 8, 9, 10, 15, 20, 25, 30, 40, 50 or more conditions reflecting or simulating different aspects of toxicity conditions are investigated in the custom built toxicity model. In one embodiment, individual conditions and, in addition, combinations of at least 2, 3, 4, 5, 6, 7, 8, 9, 10, 15, 20, 25, 30, 40, 50 or more of the conditions reflecting or simulating different aspects of toxicity conditions are investigated in the custom built toxicity model. All values presented in the foregoing list can also be the upper or lower limit of ranges, that are intended to be a part of this invention, e.g., between 1 and 5, 1 and 10, 1 and 20, 1 and 30, 2 and 5, 2 and 10, 5 and 10, 1 and 20, 5 and 20, 10 and 20, 10 and 25, 10 and 30 or 10 and 50 different conditions.

Listed herein below are a few exemplary combinations of conditions that can be used to treat cells for building drug-induced toxicity models. Other combinations can be readily formulated depending on the specific interrogative biological assessment that is being conducted.

1. Media only
2. 50 µM CTL Coenzyme Q10 (CoQ10)
3. 100 µM CTL Coenzyme Q10
4. 12.5 mM Lactic Acid
5. 12.5 mM Lactic Acid+50 µM CTL Coenzyme Q10
6. 12.5 mM Lactic Acid+100 µM CTL Coenzyme Q10
7. Hypoxia
8. Hypoxia+50 µM CTL Coenzyme Q10
9. Hypoxia+100 µM CTL Coenzyme Q10
10. Hypoxia+12.5 mM Lactic Acid
11. Hypoxia+12.5 mM Lactic Acid+50 µM CTL Coenzyme Q10
12. Hypoxia+12.5 mM Lactic Acid+100 µM CTL Coenzyme Q10
13. Media+22 mM Glucose
14. 50 µM CTL Coenzyme Q10+22 mM Glucose
15. 100 µM CTL Coenzyme Q10+22 mM Glucose
16. 12.5 mM Lactic Acid+22 mM Glucose
17. 12.5 mM Lactic Acid+22 mM Glucose+50 µM CTL Coenzyme Q10
18. 12.5 mM Lactic Acid+22 mM Glucose+100 µM CTL Coenzyme Q10
19. Hypoxia+22 mM Glucose
20. Hypoxia+22 mM Glucose+50 µM CTL Coenzyme Q10
21. Hypoxia+22 mM Glucose+100 µM CTL Coenzyme Q10
22. Hypoxia+12.5 mM Lactic Acid+22 mM Glucose
23. Hypoxia+12.5 mM Lactic Acid+22 mM Glucose+50 µM CTL Coenzyme Q10
24. Hypoxia+12.5 mM Lactic Acid+22 mM Glucose+100 µM CTL Coenzyme Q10

As a control one or more cell lines (e.g., cardiomyocytes, diabetic cardiomyocytes, hepatocytes, kidney cells, neural cells, renal cells, or myoblasts) are cultured under control conditions in order to identify toxicity unique proteins or pathways (see below). The control may be the comparison cell model described above.

Multiple cells of the same or different origin (for example, cardiomyocytes, diabetic cardiomyocytes, hepatocytes, kidney cells, neural cells, renal cells, or myoblasts), as opposed to a single cell type, may be included in the toxicity model. In certain situations, cross talk or ECS experiments between different cells (cardiomyocytes, diabetic cardiomyocytes, hepatocytes, kidney cells, neuro cells, renal cells, or myoblasts) may be conducted for several inter-related purposes.

In some embodiments that involve cross talk, experiments conducted on the cell models are designed to determine modulation of cellular state or function of one cell system or population (e.g., cardiomyocytes) by another cell system or population (e.g., diabetic cardiomyocytes) under defined treatment conditions (e.g., hyperglycemia, hypoxia (ischemia)). According to a typical setting, a first cell system/population is contacted by an external stimulus components, such as a candidate molecule (e.g., a small drug molecule, a protein) or a candidate condition (e.g., hypoxia, high glucose environment). In response, the first cell system/population changes its transcriptome, proteome, metabolome, and/or interactome, leading to changes that can be readily detected both inside and outside the cell. For example, changes in transcriptome can be measured by the transcription level of a plurality of target mRNAs; changes in proteome can be measured by the expression level of a plurality of target proteins; and changes in metabolome can be measured by the level of a plurality of target metabolites by assays designed specifically for given metabolites. Alternatively, the above referenced changes in metabolome and/or proteome, at least with respect to certain secreted metabolites or proteins, can also be measured by their effects on the second cell system/population, including the modulation of the transcriptome, proteome, metabolome, and interactome of the second cell system/population. Therefore, the experiments can be used to identify the effects of the molecule(s) of interest secreted by the first cell system/population on a second cell system/population under different treatment conditions. The experiments can also be used to identify any proteins that are modulated as a result of signaling from the first cell system (in response to the external stimulus component treatment) to another cell system, by, for example, differential screening of proteomics. The same experimental setting can also be adapted for a reverse setting, such that reciprocal effects between the two cell systems can also be assessed. In general, for this type of experiment, the choice of cell line pairs is largely based on the factors such as origin, toxicity state and cellular function.

Although two-cell systems are typically involved in this type of experimental setting, similar experiments can also be designed for more than two cell systems by, for example, immobilizing each distinct cell system on a separate solid support.

Once the custom model is built, one or more "perturbations" may be applied to the system, such as genetic variation from patient to patient, or with/without treatment by certain drugs or pro-drugs. See FIG. 15D. The effects of such perturbations to the system, including the effect on cells related to drug-induced toxicity, and normal control cells, can be measured using various art-recognized or proprietary means, as described in section III.B below.

In an exemplary experiment, cardiomyocytes are conditioned in hyperglycemia and hyperlipidemia conditions, and in addition with or without an environmental perturbation, specifically treatment by a diabetic drug known for inducing cardiotoxicity and/or a potential rescue agent Coenzyme Q10.

The custom built cell model may be established and used throughout the steps of the Platform Technology of the invention to ultimately identify a causal relationship unique in the drug-induced toxicity system, by carrying out the steps described herein. It will be understood by the skilled artisan, however, that a custom built cell model that is used to generate an initial, "first generation" consensus causal relationship network for a drug-induced toxicity can continually evolve or expand over time, e.g., by the introduction of additional drug-induced toxicity related cell lines and/or additional drug-induced toxicity related conditions. Additional data from the evolved cell model, i.e., data from the newly added portion(s) of the cell model, can be collected. The new data collected from an expanded or evolved cell model, i.e., from newly added portion(s) of the cell model, can then be introduced to the data sets previously used to generate the "first generation" consensus causal relationship network in order to generate a more robust "second generation" consensus causal relationship network. New causal relationships unique to the drug-induced toxicity can then be identified from the "second generation" consensus causal relationship network. In this way, the evolution of the cell model provides an evolution of the consensus causal relationship networks, thereby providing new and/or more reliable insights into the modulators of the drug-induced toxicity.

Custom models can also be designed to assess toxicity of drugs used in combination. For example, therapeutic agents for the treatment of a number of conditions including cancer, auto-immune disease, or HIV are typically administered as cocktails of combinations of agents. Further, many subjects have multiple, unrelated conditions to be treated simultaneously (e.g., diabetes, arthritis, cardiovascular disease). Models can be built, either in normal cells or in cells subjected to various culture conditions, to identify combinations of agents that may result in toxicities when administered simultaneously. Thus, the methods provided include testing combinations of agents (e.g., 2, 3, 4, 5, 6, 7, 8 or more) together to determine if the combination results in drug related toxicities, including with agents that do not result in toxicities alone.

Models can also be built for "personalized medicine" applications in which the specific combination of drugs being administered or considered for administration can be tested using the methods provided herein to determine if the combination of drugs are likely to have unacceptable toxicities. Such combinations can be tested in various cell types (e.g., cardiac cells, kidney cells, nerve cells, muscle cells, liver cells; either cell lines or primary cells cultured from the subject) grown under various conditions to mimic the subject of interest (e.g., grown in high glucose for a subject with diabetes or hypoxia for a subject with ischemia).

Additional examples of custom built cell models are described in detail herein.

B. Data Collection

In general, two types of data may be collected from any custom built model systems. One type of data (e.g., the first set of data, the third set of data) usually relates to the level of certain macromolecules, such as DNA, RNA, protein, lipid, etc. An exemplary data set in this category is proteomic data (e.g., qualitative and quantitative data concerning the expression of all or substantially all measurable proteins from a sample). The other type of data is generally functional data (e.g., the second set of data, the fourth set of data) that reflects the phenotypic changes resulting from the changes in the first type of data. Functional activity or cellular response of the cells can include any one or more of bioenergetics, cell proliferation, apoptosis, organellar function, a genotype-phenotype association actualized by functional models selected from ATP, ROS, OXPHOS, and Seahorse assays, global enzyme activity (e.g., global kinase activity), and an effect of global enzyme activity on the enzyme metabolic substrates of cells associated with drug-induced toxicity (e.g., phosphoproteomic data).

With respect to the first type of data, in some example embodiments, quantitative polymerase chain reaction (qPCR) and proteomics are performed to profile changes in cellular mRNA and protein expression by quantitative polymerase chain reaction (qPCR) and proteomics. Total RNA can be isolated using a commercial RNA isolation kit. Following cDNA synthesis, specific commercially available qPCR arrays (e.g., those from SA Biosciences) for disease area or cellular processes such as angiogenesis, apoptosis, and diabetes, may be employed to profile a predetermined set of genes by following a manufacturer's instructions. For example, the Biorad cfx-384 amplification system can be used for all transcriptional profiling experiments. Following data collection (Ct), the final fold change over control can be determined using the δCt method as outlined in manufacturer's protocol. Proteomic sample analysis can be performed as described in subsequent sections.

The subject method may employ large-scale high-throughput quantitative proteomic analysis of hundreds of samples of similar character, and provides the data necessary for identifying the cellular output differentials.

There are numerous art-recognized technologies suitable for this purpose. An exemplary technique, iTRAQ analysis in combination with mass spectrometry, is briefly described below.

The quantitative proteomics approach is based on stable isotope labeling with the 8-plex iTRAQ reagent and 2D-LC MALDI MS/MS for peptide identification and quantification. Quantification with this technique is relative: peptides and proteins are assigned abundance ratios relative to a reference sample. Common reference samples in multiple iTRAQ experiments facilitate the comparison of samples across multiple iTRAQ experiments.

For example, to implement this analysis scheme, six primary samples and two control pool samples can be combined into one 8-plex iTRAQ mix according to the manufacturer's suggestions. This mixture of eight samples then can be fractionated by two-dimensional liquid chromatography; strong cation exchange (SCX) in the first dimension, and reversed-phase HPLC in the second dimension, then can be subjected to mass spectrometric analysis.

A brief overview of exemplary laboratory procedures that can be employed is provided herein.

Protein Extraction:

Cells can be lysed with 8 M urea lysis buffer with protease inhibitors (Thermo Scientific Halt Protease inhibitor EDTA-free) and incubate on ice for 30 minutes with vertex for 5 seconds every 10 minutes. Lysis can be completed by ultrasonication in 5 seconds pulse. Cell lysates can be centrifuged at 14000×g for 15 minutes (4° C.) to remove cellular debris. Bradford assay can be performed to determine the protein concentration. 100 ug protein from each samples can be reduced (10 mM Dithiothreitol (DTT), 55° C., 1 h), alkylated (25 mM iodoacetamide, room temperature, 30 minutes) and digested with Trypsin (1:25 w/w, 200 mM triethylammonium bicarbonate (TEAB), 37° C., 16 h).

Secretome Sample Preparation:

1) In one embodiment, the cells can be cultured in serum free medium: Conditioned media can be concentrated by freeze dryer, reduced (10 mM Dithiothreitol (DTT), 55° C., 1 h), alkylated (25 mM iodoacetamide, at room temperature, incubate for 30 minutes), and then desalted by acetone precipitation. Equal amount of proteins from the concentrated conditioned media can be digested with Trypsin (1:25 w/w, 200 mM triethylammonium bicarbonate (TEAB), 37° C., 16 h).

In one embodiment, the cells can be cultured in serum containing medium: The volume of the medium can be reduced using 3 k MWCO Vivaspin columns (GE Healthcare Life Sciences), then can be reconstituted with 1×PBS (Invitrogen). Serum albumin can be depleted from all samples using AlbuVoid column (Biotech Support Group, LLC) following the manufacturer's instructions with the modifications of buffer-exchange to optimize for condition medium application.

ITRAQ 8 Plex Labeling:

Aliquot from each tryptic digests in each experimental set can be pooled together to create the pooled control sample. Equal aliquots from each sample and the pooled control sample can be labeled by iTRAQ 8 Plex reagents according to the manufacturer's protocols (AB Sciex). The reactions can be combined, vacuumed to dryness, re-suspended by adding 0.1% formic acid, and analyzed by LC-MS/MS.

2D-NanoLC-MS/MS:

All labeled peptides mixtures can be separated by online 2D-nanoLC and analysed by electrospray tandem mass spectrometry. The experiments can be carried out on an Eksigent 2D NanoLC Ultra system connected to an LTQ Orbitrap Velos mass spectrometer equipped with a nano-electrospray ion source (Thermo Electron, Bremen, Germany).

The peptides mixtures can be injected into a 5 cm SCX column (300 μm ID, 5 μm, PolySULFOETHYL Aspartamide column from PolyLC, Columbia, Md.) with a flow of 4 μL/min and eluted in 10 ion exchange elution segments into a C18 trap column (2.5 cm, 100 μm ID, 5 μm, 300 Å ProteoPep II from New Objective, Woburn, Mass.) and washed for 5 min with H2O/0.1% FA. The separation then can be further carried out at 300 nL/min using a gradient of 2-45% B (H2O/0.1% FA (solvent A) and ACN/0.1% FA (solvent B)) for 120 minutes on a 15 cm fused silica column (75 μm ID, 5 μm, 300 Å ProteoPep II from New Objective, Woburn, Mass.).

Full scan MS spectra (m/z 300-2000) can be acquired in the Orbitrap with resolution of 30,000. The most intense ions (up to 10) can be sequentially isolated for fragmentation using High energy C-trap Dissociation (HCD) and dynamically exclude for 30 seconds. HCD can be conducted with an isolation width of 1.2 Da. The resulting fragment ions can be scanned in the orbitrap with resolution of 7500. The LTQ Orbitrap Velos can be controlled by Xcalibur 2.1 with foundation 1.0.1.

Peptides/Proteins Identification and Quantification:

Peptides and proteins can be identified by automated database searching using Proteome Discoverer software (Thermo Electron) with Mascot search engine against SwissProt database. Search parameters can include 10 ppm for MS tolerance, 0.02 Da for MS2 tolerance, and full trypsin digestion allowing for up to 2 missed cleavages. Carbamidomethylation (C) can be set as the fixed modification. Oxidation (M), TMT6, and deamidation (NQ) can be set as dynamic modifications. Peptides and protein identifications can be filtered with Mascot Significant Threshold (p<0.05). The filters can be allowed a 99% confidence level of protein identification (1% FDA).

The Proteome Discoverer software can apply correction factors on the reporter ions, and can reject all quantitation values if not all quantitation channels are present. Relative protein quantitation can be achieved by normalization at the mean intensity.

With respect to the second type of data, in some exemplary embodiments, bioenergetics profiling of cancer and normal models may employ the Seahorse™ XF24 analyzer to enable the understanding of glycolysis and oxidative phosphorylation components.

Specifically, cells can be plated on Seahorse culture plates at optimal densities. These cells can be plated in 100 μl of media or treatment and left in a 37° C. incubator with 5% $CO_2$. Two hours later, when the cells are adhered to the 24 well plate, an additional 150 μl of either media or treatment solution can be added and the plates can be left in the culture incubator overnight. This two step seeding procedure allows for even distribution of cells in the culture plate. Seahorse cartridges that contain the oxygen and pH sensor can be hydrated overnight in the calibrating fluid in a non-$CO_2$ incubator at 37° C. Three mitochondrial drugs are typically loaded onto three ports in the cartridge. Oligomycin, a complex III inhibitor, FCCP, an uncoupler and Rotenone, a complex I inhibitor can be loaded into ports A, B and C respectively of the cartridge. All stock drugs can be prepared at a 10× concentration in an unbuffered DMEM media. The cartridges can be first incubated with the mitochondrial compounds in a non-$CO_2$ incubator for about 15 minutes prior to the assay. Seahorse culture plates can be washed in DMEM based unbuffered media that contains glucose at a concentration found in the normal growth media. The cells can be layered with 630 ul of the unbuffered media and can be equilibrated in a non-$CO_2$ incubator before placing in the Seahorse instrument with a precalibrated cartridge. The instrument can be run for three-four loops with a mix, wait and measure cycle for get a baseline, before injection of drugs through the port is initiated. There can be two loops before the next drug is introduced.

OCR (Oxygen consumption rate) and ECAR (Extracellular Acidification Rate) can be recorded by the electrodes in a 7 µl chamber and can be created with the cartridge pushing against the seahorse culture plate.

C. Data Integration and in Silico Model Generation

Once relevant data sets have been obtained, integration of data sets and generation of computer-implemented statistical models may be performed using an AI-based informatics system or platform (e.g, the REFS™ platform). For example, an exemplary AI-based system may produce simulation-based networks of protein associations as key drivers of metabolic end points (ECAR/OCR). See FIG. 15. Some background details regarding the REFS™ system may be found in Xing et al., "Causal Modeling Using Network Ensemble Simulations of Genetic and Gene Expression Data Predicts Genes Involved in Rheumatoid Arthritis," *PLoS Computational Biology*, vol. 7, issue. 3, 1-19 (March 2011) (e100105) and U.S. Pat. No. 7,512,497 to Periwal, the entire contents of each of which is expressly incorporated herein by reference in its entirety. In essence, as described earlier, the REFS™ system is an AI-based system that employs mathematical algorithms to establish causal relationships among the input variables (e.g., protein expression levels, mRNA expression levels, and the corresponding functional data, such as the OCR/ECAR values measured on Seahorse culture plates). This process is based only on the input data alone, without taking into consideration prior existing knowledge about any potential, established, and/or verified biological relationships.

In particular, a significant advantage of the platform of the invention is that the AI-based system is based on the data sets obtained from the cell model, without resorting to or taking into consideration any existing knowledge in the art concerning the biological process. Further, preferably, no data points are statistically or artificially cut-off and, instead, all obtained data is fed into the AI-system for determining protein associations. Accordingly, the resulting statistical models generated from the platform are unbiased, since they do not take into consideration any known biological relationships.

Specifically, data from the proteomics and ECAR/OCR can be input into the AI-based information system, which builds statistical models based on data associations, as described above. Simulation-based networks of protein associations are then derived for each disease versus normal scenario, including treatments and conditions using the following methods.

Figure 16:
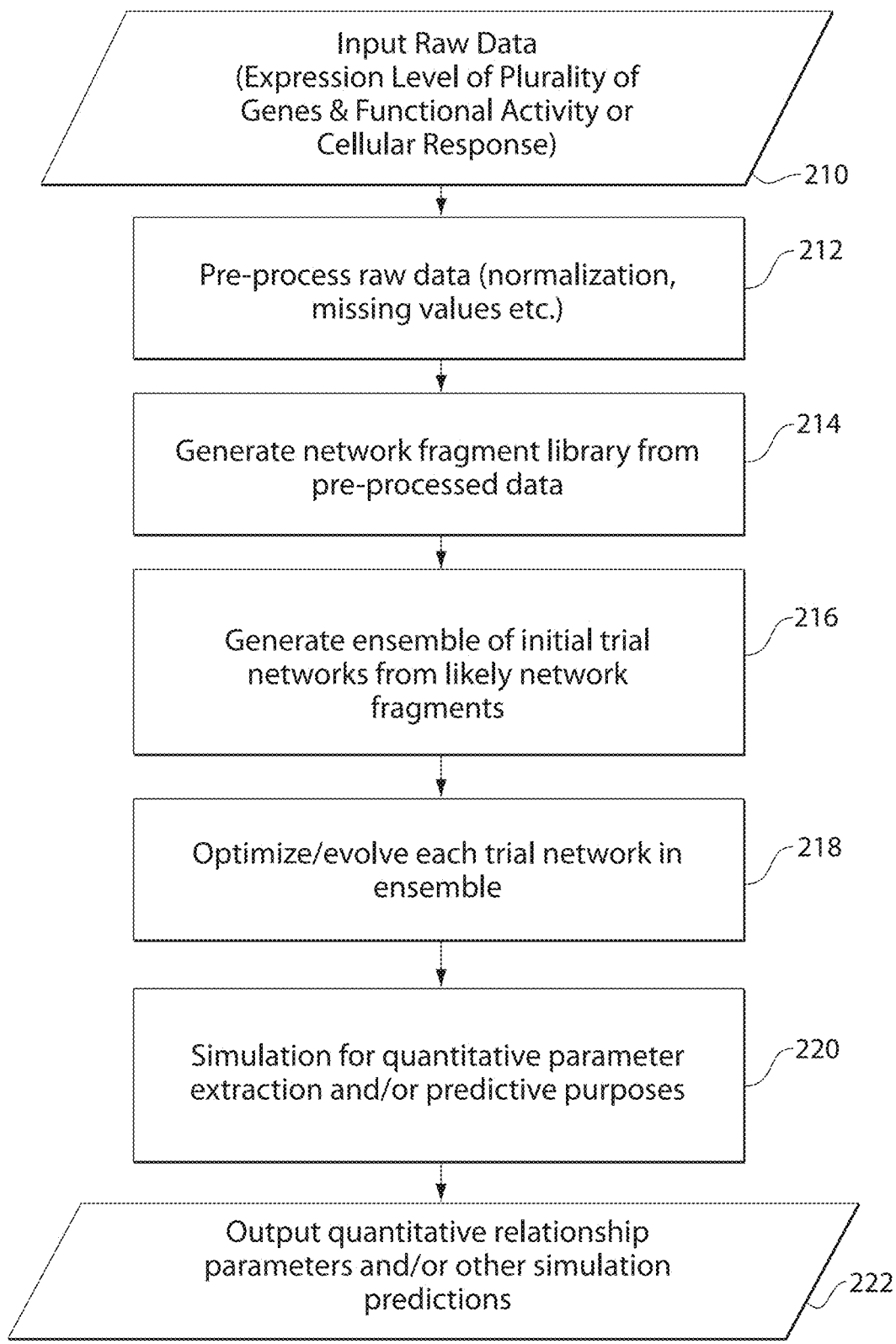
FIG. 16: Flow chart of process in AI-based informatics system that may be used with some exemplary embodiments.

A detailed description of an exemplary process for building the generated (e.g., optimized or evolved) networks appears below with respect to FIG. 16. As described above, data from the proteomics and functional cell data is input into the AI-based system (step 210). The input data, which may be raw data or minimally processed data, is pre-processed, which may include normalization (e.g., using a quantile function or internal standards) (step 212). The pre-processing may also include imputing missing data values (e.g., by using the K-nearest neighbor (K-NN) algorithm) (step 212).

The pre-processed data is used to construct a network fragment library (step 214). The network fragments define quantitative, continuous relationships among all possible small sets (e.g., 2-3 member sets or 2-4 member sets) of measured variables (input data). The relationships between the variables in a fragment may be linear, logistic, multinomial, dominant or recessive homozygous, etc. The relationship in each fragment is assigned a Bayesian probabilistic score that reflect how likely the candidate relationship is given the input data, and also penalizes the relationship for its mathematical complexity. By scoring all of the possible pairwise and three-way relationships (and in some embodiments also four-way relationships) inferred from the input data, the most likely fragments in the library can be identified (the likely fragments). Quantitative parameters of the relationship are also computed based on the input data and stored for each fragment. Various model types may be used in fragment enumeration including but not limited to linear regression, logistic regression, (Analysis of Variance) ANOVA models, (Analysis of Covariance) ANCOVA models, non-linear/polynomial regression models and even non-parametric regression. The prior assumptions on model parameters may assume Gull distributions or Bayesian Information Criterion (BIC) penalties related to the number of parameters used in the model. In a network inference process, each network in an ensemble of initial trial networks is constructed from a subset of fragments in the fragment library. Each initial trial network in the ensemble of initial trial networks is constructed with a different subset of the fragments from the fragment library (step 216).

An overview of the mathematical representations underlying the Bayesian networks and network fragments, which is based on Xing et al., "Causal Modeling Using Network Ensemble Simulations of Genetic and Gene Expression Data Predicts Genes Involved in Rheumatoid Arthritis," *PLoS Computational Biology*, vol. 7, issue. 3, 1-19 (March 2011) (e100105), is presented below.

A multivariate system with random variables $X=X_1, \ldots, X_n$ may be characterized by a multivariate probability distribution function $P(X_1, \ldots, X_n; \Theta)$, that includes a large number of parameters $\Theta$. The multivariate probability distribution function may be factorized and represented by a product of local conditional probability distributions:

$$P(X_1, \ldots, X_n; \Theta) = \prod_{i=1}^{n} P_i(X_i | Y_{j1}, \ldots, Y_{jK_i}; \Theta_i),$$

in which each variable $X_i$ is independent from its non-descendent variables given its $K_i$ parent variables, which are $Y_{j1}, \ldots, Y_{jK_i}$. After factorization, each local probability distribution has its own parameters $\Theta_i$.

The multivariate probability distribution function may be factorized in different ways with each particular factorization and corresponding parameters being a distinct probabilistic model. Each particular factorization (model) can be represented by a Directed Acrylic Graph (DAC) having a vertex for each variable $X_i$ and directed edges between vertices representing dependences between variables in the local conditional distributions $P_i(X_i|Y_{j1}, \ldots, Y_{jK_i})$. Subgraphs of a DAG, each including a vertex and associated directed edges are network fragments.

A model is evolved or optimized by determining the most likely factorization and the most likely parameters given the input data. This may be described as "learning a Bayesian network," or, in other words, given a training set of input data, finding a network that best matches the input data. This is accomplished by using a scoring function that evaluates each network with respect to the input data.

A Bayesian framework is used to determine the likelihood of a factorization given the input data. Bayes Law states that the posterior probability, P(D|M), of a model M, given data D is proportional to the product of the product of the posterior probability of the data given the model assumptions, P(D|M), multiplied by the prior probability of the model, P(M), assuming that the probability of the data, P(D), is constant across models. This is expressed in the following equation:

$$P(M|D) = \frac{P(D|M) * P(M)}{P(D)}.$$

The posterior probability of the data assuming the model is the integral of the data likelihood over the prior distribution of parameters:

$$P(D|M) = \int P(D|M(\Theta)) P(\Theta|M) d\Theta.$$

Assuming all models are equally likely (i.e., that P(M) is a constant), the posterior probability of model M given the data D may be factored into the product of integrals over parameters for each local network fragment $M_i$ as follows:

$$P(M|D) = \prod_{i=1}^{n} \int P_i(X_i | Y_{j1}, \ldots, Y_{jK_i}; \Theta_i).$$

Note that in the equation above, a leading constant term has been omitted. In some embodiments, a Bayesian Information Criterion (BIC), which takes a negative logarithm of the posterior probability of the model P(D|M) may be used to "Score" each model as follows:

$$S_{tot}(M) = -\log P(M|D) = \sum_{i=1}^{n} S(M_i),$$

where the total score $S_{tot}$ for a model M is a sum of the local scores $S_i$ for each local network fragment. The BIC further gives an expression for determining a score each individual network fragment:

$$S(M_i) \approx S_{BIC}(M_i) = S_{MLE}(M_i) + \frac{\kappa(M_i)}{2} \log N$$

where $\kappa(M_i)$ is the number of fitting parameter in model $M_i$ and N is the number of samples (data points). $S_{MLE}(M_i)$ is the negative logarithm of the likelihood function for a network fragment, which may be calculated from the functional relationships used for each network fragment. For a BIC score, the lower the score, the more likely a model fits the input data.

The ensemble of trial networks is globally optimized, which may be described as optimizing or evolving the networks (step 218). For example, the trial networks may be evolved and optimized according to a Metropolis Monte Carlo Sampling algorithm. Simulated annealing may be used to optimize or evolve each trial network in the ensemble through local transformations. In an example simulated annealing processes, each trial network is changed by adding a network fragment from the library, by deleted a network fragment from the trial network, by substituting a network fragment or by otherwise changing network topology, and then a new score for the network is calculated. Generally speaking, if the score improves, the change is kept and if the score worsens the change is rejected. A "temperature" parameter allows some local changes which worsen the score to be kept, which aids the optimization process in avoiding some local minima. The "temperature" parameter is decreased over time to allow the optimization/evolution process to converge.

All or part of the network inference process may be conducted in parallel for the trial different networks. Each network may be optimized in parallel on a separate processor and/or on a separate computing device. In some embodiments, the optimization process may be conducted on a supercomputer incorporating hundreds to thousands of processors which operate in parallel. Information may be shared among the optimization processes conducted on parallel processors.

The optimization process may include a network filter that drops any networks from the ensemble that fail to meet a threshold standard for overall score. The dropped network may be replaced by a new initial network. Further any networks that are not "scale free" may be dropped from the ensemble. After the ensemble of networks has been optimized or evolved, the result may be termed an ensemble of generated cell model networks, which may be collectively referred to as the generated consensus network.

D. Simulation to Extract Quantitative Relationship Information and for Prediction Simulation may be used to extract quantitative parameter information regarding each relationship in the generated cell model networks (step 220). For example, the simulation for quantitative information extraction may involve perturbing (increasing or decreasing) each node in the network by 10 fold and calculating the posterior distributions for the other nodes (e.g., proteins) in the models. The endpoints are compared by t-test with the assumption of 100 samples per group and the 0.01 significance cut-off. The t-test statistic is the median of 100 t-tests. Through use of this simulation technique, an AUC (area under the curve) representing the strength of prediction and fold change representing the in silico magnitude of a node driving an end point are generated for each relationship in the ensemble of networks.

A relationship quantification module of a local computer system may be employed to direct the AI-based system to perform the perturbations and to extract the AUC information and fold information. The extracted quantitative information may include fold change and AUC for each edge connecting a parent note to a child node. In some embodiments, a custom-built R program may be used to extract the quantitative information.

In some embodiments, the ensemble of generated cell model networks can be used through simulation to predict responses to changes in conditions, which may be later verified though wet-lab cell-based, or animal-based, experiments.

The output of the AI-based system may be quantitative relationship parameters and/or other simulation predictions (222).

E. Generation of Differential (Delta) Networks

A differential network creation module may be used to generate differential (delta) networks between generated cell model networks and generated comparison cell model networks. As described above, in some embodiments, the differential network compares all of the quantitative parameters of the relationships in the generated cell model networks and the generated comparison cell model network. The quantitative parameters for each relationship in the differential network are based on the comparison. In some embodiments, a differential may be performed between various differential networks, which may be termed a delta-delta network. An example of a delta-delta network is described below with respect to FIG. 18 in the Examples section. The differential network creation module may be a program or script written in PERL.

F. Visualization of Networks

The relationship values for the ensemble of networks and for the differential networks may be visualized using a network visualization program (e.g., Cytoscape open source platform for complex network analysis and visualization from the Cytoscape consortium). In the visual depictions of the networks, the thickness of each edge (e.g., each line connecting the proteins) represents the strength of fold change. The edges are also directional indicating causality, and each edge has an associated prediction confidence level.

G. Exemplary Computer System

Figure 17:
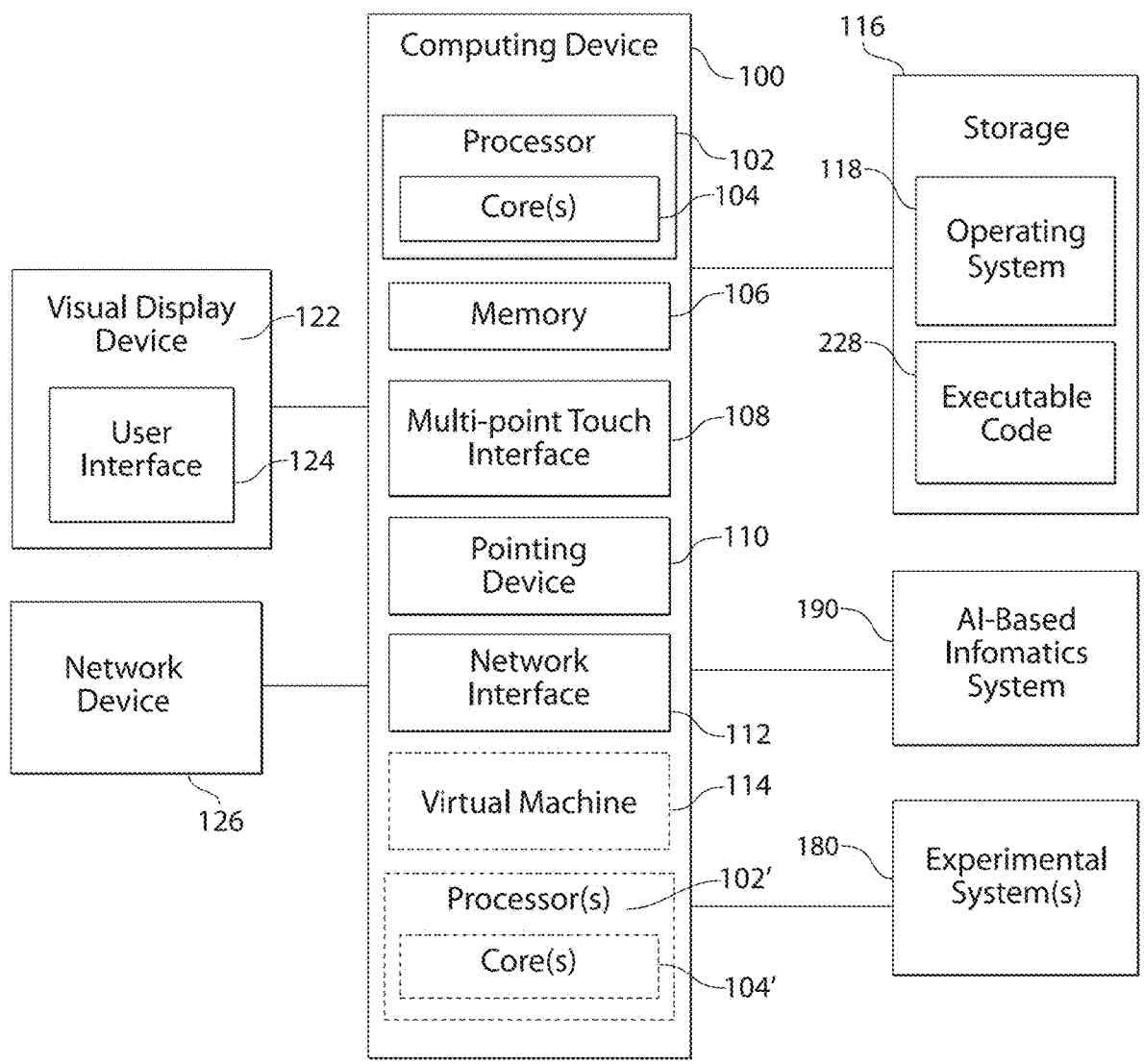
FIG. 17: Schematically depicts an exemplary computing environment suitable for practicing exemplary embodiments taught herein.

FIG. 17 schematically depicts an exemplary computer system/environment that may be employed in some embodiments for communicating with the AI-based informatics system, for generating differential networks, for visualizing networks, for saving and storing data, and/or for interacting with a user. As explained above, calculations for an AI-based informatics system may be performed on a separate supercomputer with hundreds or thousands of parallel processors that interacts, directly or indirectly, with the exemplary computer system. The environment includes a computing device 100 with associated peripheral devices. Computing device 100 is programmable to implement executable code 150 for performing various methods, or portions of methods, taught herein. Computing device 100 includes a storage device 116, such as a hard-drive, CD-ROM, or other non-transitory computer readable media. Storage device 116 may store an operating system 118 and other related software. Computing device 100 may further include memory 106. Memory 106 may comprise a computer system memory or random access memory, such as DRAM, SRAM, EDO RAM, etc. Memory 106 may comprise other types of memory as well, or combinations thereof. Computing device 100 may store, in storage device 116 and/or memory 106, instructions for implementing and processing each portion of the executable code 150.

The executable code 150 may include code for communicating with the AI-based informatics system 190, for generating differential networks (e.g., a differential network creation module), for extracting quantitative relationship information from the AI-based informatics system (e.g., a relationship quantification module) and for visualizing networks (e.g., Cytoscape).

In some embodiments, the computing device 100 may communicate directly or indirectly with the AI-based informatics system 190 (e.g., a system for executing REFS). For example, the computing device 100 may communicate with the AI-based informatics system 190 by transferring data files (e.g., data frames) to the AI-based informatics system 190 through a network. Further, the computing device 100 may have executable code 150 that provides an interface and instructions to the AI-based informatics system 190.

In some embodiments, the computing device 100 may communicate directly or indirectly with one or more experimental systems 180 that provide data for the input data set. Experimental systems 180 for generating data may include systems for mass spectrometry based proteomics, microarray gene expression, qPCR gene expression, mass spectrometry based metabolomics, and mass spectrometry based lipidomics, SNP microarrays, a panel of functional assays, and other in-vitro biology platforms and technologies.

Computing device 100 also includes processor 102, and may include one or more additional processor(s) 102', for executing software stored in the memory 106 and other programs for controlling system hardware, peripheral devices and/or peripheral hardware. Processor 102 and processor(s) 102' each can be a single core processor or multiple core (104 and 104') processor. Virtualization may be employed in computing device 100 so that infrastructure and resources in the computing device can be shared dynamically. Virtualized processors may also be used with executable code 150 and other software in storage device 116. A virtual machine 114 may be provided to handle a process running on multiple processors so that the process appears to be using only one computing resource rather than multiple. Multiple virtual machines can also be used with one processor.

A user may interact with computing device 100 through a visual display device 122, such as a computer monitor, which may display a user interface 124 or any other interface. The user interface 124 of the display device 122 may be used to display raw data, visual representations of networks, etc. The visual display device 122 may also display other aspects or elements of exemplary embodiments (e.g., an icon for storage device 116). Computing device 100 may include other I/O devices such a keyboard or a multi-point touch interface (e.g., a touchscreen) 108 and a pointing device 110, (e.g., a mouse, trackball and/or trackpad) for receiving input from a user. The keyboard 108 and the pointing device 110 may be connected to the visual display device 122 and/or to the computing device 100 via a wired and/or a wireless connection.

Computing device 100 may include a network interface 112 to interface with a network device 126 via a Local Area Network (LAN), Wide Area Network (WAN) or the Internet through a variety of connections including, but not limited to, standard telephone lines, LAN or WAN links (e.g., 802.11, T1, T3, 56 kb, X.25), broadband connections (e.g., ISDN, Frame Relay, ATM), wireless connections, controller area network (CAN), or some combination of any or all of the above. The network interface 112 may comprise a built-in network adapter, network interface card, PCMCIA network card, card bus network adapter, wireless network adapter, USB network adapter, modem or any other device suitable for enabling computing device 100 to interface with any type of network capable of communication and performing the operations described herein.

Moreover, computing device 100 may be any computer system such as a workstation, desktop computer, server, laptop, handheld computer or other form of computing or telecommunications device that is capable of communication and that has sufficient processor power and memory capacity to perform the operations described herein.

Computing device 100 can be running any operating system 118 such as any of the versions of the MICROSOFT WINDOWS operating systems, the different releases of the Unix and Linux operating systems, any version of the MACOS for Macintosh computers, any embedded operating system, any real-time operating system, any open source operating system, any proprietary operating system, any operating systems for mobile computing devices, or any other operating system capable of running on the computing device and performing the operations described herein. The operating system may be running in native mode or emulated mode.

IV. Models for Drug-Induced Toxicity and Uses Therefor

A. Establishing a Model for Drug-Induced Toxicity

Virtually all drug-induced toxicity involves complicated interactions among different cell types and/or organ systems. Perturbation of critical functions in one cell type or organ may lead to secondary effects on other interacting cells types and organs, and such downstream changes may in turn feedback to the initial changes and cause further complications. Therefore, it is beneficial to dissect a given drug-induced toxicity to its components, such as interaction between pairs of cell types or organs, and systemically probe the interactions between these components in order to gain a more complete, global view of the drug-induced toxicity process.

Accordingly, the present invention provides cell models for drug-induced toxicity. To this end, Applicants have built cell models for an exemplary drug-induced toxicity (e.g., cardiotoxicity) which have been employed in the subject discovery Platform Technology. Applicants have conducted experiments with the cell models using the subject discovery Platform Technology to generate consensus causal relationship networks, including causal relationships unique in the drug-induced toxicity, and thereby identify "modulators" or critical molecular "drivers" important for the particular drug-induced toxicity.

One significant advantage of the Platform Technology and its components, e.g., the custom built cell models and data sets obtained from the drug-induced toxicity cell models, is that an initial, "first generation" consensus causal relationship network generated for a drug-induced toxicity can continually evolve or expand over time, e.g., by the introduction of additional cell lines/types and/or additional conditions. Additional data from the evolved cell model, i.e., data from the newly added portion(s) of the cell model, can be collected. The new data collected from an expanded or evolved cell model, i.e., from newly added portion(s) of the cell model, can then be introduced to the data sets previously used to generate the "first generation" consensus causal relationship network in order to generate a more robust "second generation" consensus causal relationship network. New causal relationships unique to the drug-induced toxicity can then be identified from the "second generation" consensus causal relationship network. In this way, the evolution of the drug-induced toxicity cell model provides an evolution of the consensus causal relationship networks, thereby providing new and/or more reliable insights into the modulators of the drug-induced toxicity. In this way, both the drug-induced toxicity cell models, the data sets from the cell models, and the causal relationship networks generated from the drug-induced toxicity cell models by using the Platform Technology methods can constantly evolve and build upon previous knowledge obtained from the Platform Technology.

Accordingly, the invention provides consensus causal relationship networks generated from the drug-induced toxicity cell models employed in the Platform Technology. These consensus causal relationship networks may be first generation consensus causal relationship networks, or may be multiple generation consensus causal relationship networks, e.g., $2^{nd}$, $3^{rd}$, $4^{th}$, $5^{th}$, $6^{th}$, $7^{th}$, $8^{th}$, $9^{th}$, $10^{th}$, $11^{th}$, $12^{th}$, $13^{th}$, $14^{th}$, $15^{th}$, $16^{th}$, $17^{th}$, $18^{th}$, $19^{th}$, $20^{th}$ or greater generation consensus causal relationship networks. Further, the invention provides simulated consensus causal relationship networks generated from the drug-induced toxicity cell models employed in the Platform Technology. These simulated consensus causal relationship networks may be first generation simulated consensus causal relationship networks, or may be multiple generation simulated consensus causal relationship networks, e.g., $2^{nd}$, $3^{rd}$, $4^{th}$, $5^{th}$, $6^{th}$, $7^{th}$, $8^{th}$, $9^{th}$, $10^{th}$, $11^{11}$, $12^{th}$, $13^{th}$, $14^{th}$, $15^{th}$, $16^{th}$, $17^{th}$, $18^{th}$, $19^{th}$, $20^{th}$ or greater simulated generation consensus causal relationship networks. The invention further provides delta networks and delta-delta networks generated from any of the consensus causal relationship networks of the invention.

A custom built cell model for a drug-induced toxicity comprises one or more cells associated with the drug-induced toxicity. The model for a drug-induced toxicity may be established to simulate an environment of the drug-induced toxicity, e.g., environment of drug-induced cardiotoxicity in vivo, by creating conditions (e.g., cell culture conditions) that mimic a characteristic aspect of the drug-induced toxicity.

Multiple cells of the same or different origin, as opposed to a single cell type, may be included in the cell model. In one embodiment, at least 1, 2, 3, 4, 5, 6, 7, 8, 9, 10, 11, 12, 13, 14, 15, 16, 17, 18, 19, 20, 25, 30, 35, 40, 50 or more different cell lines or cell types are included in the drug-induced toxicity cell model. In one embodiment, the cells are all of the same type, e.g., all cardiomyocytes, but are different established cell lines, e.g., different established cell lines of cardiomyocytes. All values presented in the foregoing list can also be the upper or lower limit of ranges, that are intended to be a part of this invention, e.g., between 1 and 5, 1 and 10, 2 and 5, or 5 and 15 different cell lines or cell types.

Examples of cell types that may be included in the cell models of the invention include, without limitation, human cells, animal cells, mammalian cells, plant cells, yeast, bacteria, or fungae. In one embodiment, cells of the cell model can include diseased cells, such as cancer cells or bacterially or virally infected cells. In one embodiment, cells of the cell model can include drug-induced toxicity associated cells, such as cells involved in diabetes, obesity or cardiovascular drug-induced toxicity state, e.g., aortic smooth muscle cells or hepatocytes. The skilled person would recognize those cells that are involved in or associated with a particular drug-induced toxicity, e.g., cardiotoxicity, hepatotoxicity, nephrotoxicity, neurotoxicity, renaltoxicity, or myotoxicity, and any such cells may be included in a cell model of the invention, e.g., cardiomyocytes, diabetic cardiomyocytes, hepatocytes, kidney cells, neuro cells, renal cells, or myoblasts.

Cell models of the invention may include one or more "control cells." In one embodiment, a control cell may be an untreated or unperturbed cell. In another embodiment, a "control cell" may be a normal cell, e.g., a cell that has not been exposed to a toxicity-causing agent or drug. In one embodiment, at least 1, 2, 3, 4, 5, 6, 7, 8, 9, 10, 11, 12, 13, 14, 15, 16, 17, 18, 19, 20, 25, 30, 35, 40, 45, 50 or more different control cells are included in the cell model. All values presented in the foregoing list can also be the upper or lower limit of ranges, that are intended to be a part of this invention, e.g., between 1 and 5, 1 and 10, 2 and 5, or 5 and 15 different control cell lines or control cell types. In one embodiment, the control cells are all of the same type but are different established cell lines of that cell type. In one embodiment, as a control, one or more normal, e.g., non-diseased, cell lines are cultured under similar conditions, and/or are exposed to the same perturbation, as the primary cells of the cell model in order to identify proteins or pathways unique to the drug-induced toxicity.

A custom cell model of the invention may also comprise conditions that mimic a characteristic aspect of the drug-induced toxicity. For example, cell culture conditions may be selected that closely approximating the conditions of a cell in a diabetic environment in vivo for probing diabetic drug induced toxicity, or of an aortic smooth muscle cell of a patient suffering from drug-induced cardiotoxicity. In some instances, the conditions are stress conditions. Various conditions/stressors may be employed in the cell models of the invention. In one embodiment, these stressors/conditions may constitute the "perturbation", e.g., external stimulus, for the cell systems. One exemplary stress condition is hypoxia, a condition typically found, for example, in patients with advanced stage of diabetes. Hypoxia can be induced using art-recognized methods. For example, hypoxia can be induced by placing cell systems in a Modular Incubator Chamber (MIC-101, Billups-Rothenberg Inc. Del Mar, Calif.), which can be flooded with an industrial gas mix containing 5% $CO_2$, 2% $O_2$ and 93% nitrogen. Effects can be measured after a pre-determined period, e.g., at 24 hours after hypoxia treatment, with and without additional external stimulus components (e.g., CoQ10 at 0, 50, or 100 µM). Likewise, lactic acid treatment mimics a cellular environment where glycolysis activity is high. Lactic acid induced stress can be investigated at a final lactic acid concentration of about 12.5 mM at a pre-determined time, e.g., at 24 hours, with or without additional external stimulus components (e.g., CoQ10 at 0, 50, or 100 µM). Hyperglycemia is a condition found in diabetes as well as in diabetic drug-induced toxicity. A typical hyperglycemic condition that can be used to treat the subject cells include 10% culture grade glucose added to suitable media to bring up the final concentration of glucose in the media to about 22 mM. Hyperlipidemia is a condition found, for example, in obesity and cardiovascular disease, and can be used to simulate drug-induced cardiotoxicity. The hyperlipidemic conditions can be provided by culturing cells in media containing 0.15 mM sodium palmitate. Hyperinsulinemia is a condition found, for example, in diabetes, as well as in diabetic drug-induced toxicity. The hyperinsulinemic conditions may be induced by culturing the cells in media containing 1000 nM insulin.

Individual conditions may be investigated separately in the custom built cell models of the invention, and/or may be combined together. In one embodiment, a combination of at least 2, 3, 4, 5, 6, 7, 8, 9, 10, 15, 20, 25, 30, 40, 50 or more conditions reflecting or simulating different characteristic aspects of the biological system are investigated in the custom built cell model. In one embodiment, individual conditions and, in addition, combinations of at least 2, 3, 4, 5, 6, 7, 8, 9, 10, 11, 12, 13, 14, 15, 20, 25, 30, 35, 40, 45, 50 or more of the conditions reflecting or simulating different characteristic aspects of the drug-induced toxicity are investigated in the custom built drug-induced toxicity cell model. All values presented in the foregoing list can also be the upper or lower limit of ranges, that are intended to be a part of this invention, e.g., between 1 and 5, 1 and 10, 1 and 20, 1 and 30, 2 and 5, 2 and 10, 5 and 10, 1 and 20, 5 and 20, 10 and 20, 10 and 25, 10 and 30 or 10 and 50 different conditions.

Once the custom drug-induced toxicity cell model is built, one or more "perturbations" may be applied to the system, such as genetic variation from patient to patient, or with/without treatment by certain drugs or pro-drugs. See FIG. 15D. The effects of such perturbations to the cell model system can be measured using various art-recognized or proprietary means, as described in section III.B below.

The custom built drug-induced toxicity cell model may be exposed to a perturbation, e.g., an "environmental perturbation" or "external stimulus component". The "environmental perturbation" or "external stimulus component" may be endogenous to the cellular environment (e.g., the cellular environment contains some levels of the stimulant, and more of the same is added to increase its level), or may be exogenous to the cellular environment (e.g., the stimulant/perturbation is largely absent from the cellular environment prior to the alteration). The cellular environment may further be altered by secondary changes resulting from adding the environmental perturbation or external stimulus component, since the external stimulus component may change the cellular output of the cell system, including molecules secreted into the cellular environment by the cell system. The environmental perturbation or external stimulus component may include any external physical and/or chemical stimulus that may affect cellular function. This may include any large or small organic or inorganic molecules, natural or synthetic chemicals, temperature shift, pH change, radiation, light (UVA, UVB etc.), microwave, sonic wave, electrical current, modulated or unmodulated magnetic fields, etc. The environmental perturbation or external stimulus component may also include an introduced genetic modification or mutation or a vehicle (e.g., vector) that causes a genetic modification/mutation.

(i) Cross-Talk Cell Systems

In certain situations, where interaction between two or more cell systems are desired to be investigated, a "cross-talking cell system" may be formed by, for example, bringing the modified cellular environment of a first cell system into contact with a second cell system to affect the cellular output of the second cell system.

As used herein, "cross-talk cell system" comprises two or more cell systems, in which the cellular environment of at least one cell system comes into contact with a second cell system, such that at least one cellular output in the second cell system is changed or affected. In certain embodiments, the cell systems within the cross-talk cell system may be in direct contact with one another. In other embodiments, none of the cell systems are in direct contact with one another.

For example, in certain embodiments, the cross-talk cell system may be in the form of a transwell, in which a first cell system is growing in an insert and a second cell system is growing in a corresponding well compartment. The two cell systems may be in contact with the same or different media, and may exchange some or all of the media components. External stimulus component added to one cell system may be substantially absorbed by one cell system and/or degraded before it has a chance to diffuse to the other cell system. Alternatively, the external stimulus component may eventually approach or reach an equilibrium within the two cell systems.

In certain embodiments, the cross-talk cell system may adopt the form of separately cultured cell systems, where each cell system may have its own medium and/or culture conditions (temperature, $CO_2$ content, pH, etc.), or similar or identical culture conditions. The two cell systems may come into contact by, for example, taking the conditioned medium from one cell system and bringing it into contact with another cell system. Direct cell-cell contacts between the two cell systems can also be effected if desired. For example, the cells of the two cell systems may be co-cultured at any point if desired, and the co-cultured cell systems can later be separated by, for example, FACS sorting when cells in at least one cell system have a sortable marker or label (such as a stably expressed fluorescent marker protein GFP).

Similarly, in certain embodiments, the cross-talk cell system may simply be a co-culture. Selective treatment of cells in one cell system can be effected by first treating the cells in that cell system, before culturing the treated cells in co-culture with cells in another cell system. The co-culture cross-talk cell system setting may be helpful when it is desired to study, for example, effects on a second cell system caused by cell surface changes in a first cell system, after stimulation of the first cell system by an external stimulus component.

The cross-talk cell system of the invention is particularly suitable for exploring the effect of certain pre-determined external stimulus component on the cellular output of one or both cell systems. The primary effect of such a stimulus on the first cell system (with which the stimulus directly contact) may be determined by comparing cellular outputs (e.g., protein expression level) before and after the first cell system's contact with the external stimulus, which, as used herein, may be referred to as "(significant) cellular output differentials." The secondary effect of such a stimulus on the second cell system, which is mediated through the modified cellular environment of the first cell system (such as its secretome), can also be similarly measured. There, a comparison in, for example, proteome of the second cell system can be made between the proteome of the second cell system with the external stimulus treatment on the first cell system, and the proteome of the second cell system without the external stimulus treatment on the first cell system. Any significant changes observed (in proteome or any other cellular outputs of interest) may be referred to as a "significant cellular cross-talk differential."

In making cellular output measurements (such as protein expression), either absolute expression amount or relative expression level may be used. For example, to determine the relative protein expression level of a second cell system, the amount of any given protein in the second cell system, with or without the external stimulus to the first cell system, may be compared to a suitable control cell line and mixture of cell lines and given a fold-increase or fold-decrease value. A pre-determined threshold level for such fold-increase (e.g., at least 1.2, 1.3, 1.4, 1.5, 1.6, 1.7, 1.8, 1.9, 2, 2.5, 3, 3.5, 4, 4.5, 5, 6, 7, 8, 9, 10, 15, 20, 25, 30, 35, 40, 45, 50, 75 or 100 or more fold increase) or fold-decrease (e.g., at least a decrease to 0.95, 0.9, 0.8, 0.75, 0.7, 0.6, 0.5, 0.45, 0.4, 0.35, 0.3, 0.25, 0.2, 0.15, 0.1 or 0.05 fold, or 90%, 80%, 75%, 70%, 65%, 60%, 55%, 50%, 45%, 40%, 35%, 30%, 25%, 20%, 15%, 10% or 5% or less) may be used to select significant cellular cross-talk differentials. All values presented in the foregoing list can also be the upper or lower limit of ranges, e.g., between 1.5 and 5 fold, between 2 and 10 fold, between 1 and 2 fold, or between 0.9 and 0.7 fold, that are intended to be a part of this invention.

Throughout the present application, all values presented in a list, e.g., such as those above, can also be the upper or lower limit of ranges that are intended to be a part of this invention.

To illustrate, in one exemplary two-cell system established to imitate aspects of a drug-induced cardiotoxicity and nephrotoxicity model, a heart smooth muscle cell line (first cell system) may be treated with a hypoxia condition (an external stimulus component), and proteome changes in a kidney cell line (second cell system) resulting from contacting the kidney cells with conditioned medium of the heart smooth muscle may be measured using conventional quantitative mass spectrometry. Significant cellular cross-talking differentials in these kidney cells may be determined, based on comparison with a proper control (e.g., similarly cultured kidney cells contacted with conditioned medium from similarly cultured heart smooth muscle cells not treated with hypoxia conditions).

Not every observed significant cellular cross-talking differentials may be of biological significance. With respect to any given drug-induced toxicity for which the subject interrogative biological assessment is applied, some (or maybe all) of the significant cellular cross-talking differentials may be "determinative" with respect to the specific biological problem at issue, e.g., either responsible for causing a drug-induced toxicity (a potential target for therapeutic intervention) or is a biomarker for the drug-induced toxicity (a potential diagnostic or prognostic factor).

Such determinative cross-talking differentials may be selected by an end user of the subject method, or it may be selected by a bioinformatics software program, such as DAVID-enabled comparative pathway analysis program, or the KEGG pathway analysis program. In certain embodiments, more than one bioinformatics software program is used, and consensus results from two or more bioinformatics software programs are preferred.

As used herein, "differentials" of cellular outputs include differences (e.g., increased or decreased levels) in any one or more parameters of the cellular outputs. For example, in terms of protein expression level, differentials between two cellular outputs, such as the outputs associated with a cell system before and after the treatment by an external stimulus component, can be measured and quantitated by using art-recognized technologies, such as mass-spectrometry based assays (e.g., iTRAQ, 2D-LC-MSMS, etc.).

B. Use of Cell Models for Interrogative Biological Assessments

The methods and cell models described herein, and further described in international Application No. PCT/US2012/027615, may be used for, or applied to, any number of "interrogative biological assessments." Use of the methods of the invention for an interrogative biological assessment facilitates the identification of "modulators" or determinative cellular process "drivers" of a drug-induced toxicity.

As used herein, an "interrogative biological assessment" may include the identification of one or more modulators of a biological system, e.g., determinative cellular process "drivers," (e.g., an increase or decrease in activity of a biological pathway, or key members of the pathway, or key regulators to members of the pathway) associated with the environmental perturbation or external stimulus component, or a unique causal relationship unique in a biological system or process. It may further include additional steps designed to test or verify whether the identified determinative cellular process drivers are necessary and/or sufficient for the downstream events associated with the environmental perturbation or external stimulus component, including in vivo animal models and/or in vitro tissue culture experiments.

In a preferred embodiment, the interrogative biological assessment is the assessment of the drug-induced toxicological profile of an agent, e.g., a drug, on a cell, tissue, organ or organism, wherein the identified modulators of a biological system, e.g., determinative cellular process driver (e.g., cellular cross-talk differentials or causal relationships unique in a biological system or process) may be indicators of drug-induced toxicities, e.g., cytotoxicity, cardiotoxicity, hepatotoxicity, nephrotoxicity, neurotoxicity, renaltoxicity, or myotoxicity, and may in turn be used to predict or identify the toxicological profile of the drug. In one embodiment, the identified modulators of a drug-induced toxicity, e.g., determinative cellular process driver (e.g., cellular cross-talk differentials or causal relationships unique in a drug-induced toxicity) is an indicator of cardiotoxicity of a drug or drug candidate, and may in turn be used to predict or identify the cardiotoxicological profile of the drug or drug candidate.

V. Proteomic Sample Analysis

In certain embodiments, the subject method employs large-scale high-throughput quantitative proteomic analysis of hundreds of samples of similar character, and provides the data necessary for identifying the cellular output differentials.

There are numerous art-recognized technologies suitable for this purpose. An exemplary technique, iTRAQ analysis in combination with mass spectrometry, is briefly described below.

To provide reference samples for relative quantification with the iTRAQ technique, multiple QC pools are created. Two separate QC pools, consisting of aliquots of each sample, were generated from the Cell #1 and Cell #2 samples—these samples are denoted as QCS1 and QCS2, and QCP1 and QCP2 for supernatants and pellets, respectively. In order to allow for protein concentration comparison across the two cell lines, cell pellet aliquots from the QC pools described above are combined in equal volumes to generate reference samples (QCP).

The quantitative proteomics approach is based on stable isotope labeling with the 8-plex iTRAQ reagent and 2D-LC MALDI MS/MS for peptide identification and quantification. Quantification with this technique is relative: peptides and proteins are assigned abundance ratios relative to a reference sample. Common reference samples in multiple iTRAQ experiments facilitate the comparison of samples across multiple iTRAQ experiments.

To implement this analysis scheme, six primary samples and two control pool samples are combined into one 8-plex iTRAQ mix, with the control pool samples labeled with 113 and 117 reagents according to the manufacturer's suggestions. This mixture of eight samples is then fractionated by two-dimensional liquid chromatography; strong cation exchange (SCX) in the first dimension, and reversed-phase HPLC in the second dimension. The HPLC eluent is directly fractionated onto MALDI plates, and the plates are analyzed on an MDS SCIEX/AB 4800 MALDI TOF/TOF mass spectrometer.

In the absence of additional information, it is assumed that the most important changes in protein expression are those within the same cell types under different treatment conditions. For this reason, primary samples from Cell #1 and Cell #2 are analyzed in separate iTRAQ mixes. To facilitate comparison of protein expression in Cell #1 vs. Cell #2 samples, universal QCP samples are analyzed in the available "iTRAQ slots" not occupied by primary or cell line specific QC samples (QC1 and QC2).

A brief overview of the laboratory procedures employed is provided herein.

A. Protein Extraction from Cell Supernatant Samples

For cell supernatant samples (CSN), proteins from the culture medium are present in a large excess over proteins secreted by the cultured cells. In an attempt to reduce this background, upfront abundant protein depletion was implemented. As specific affinity columns are not available for bovine or horse serum proteins, an anti-human IgY14 column was used. While the antibodies are directed against human proteins, the broad specificity provided by the polyclonal nature of the antibodies was anticipated to accomplish depletion of both bovine and equine proteins present in the cell culture media that was used.

A 200-μl aliquot of the CSN QC material is loaded on a 10-mL IgY14 depletion column before the start of the study to determine the total protein concentration (Bicinchoninic acid (BCA) assay) in the flow-through material. The loading volume is then selected to achieve a depleted fraction containing approximately 40 μg total protein.

B. Protein Extraction from Cell Pellets

An aliquot of Cell #1 and Cell #2 is lysed in the "standard" lysis buffer used for the analysis of tissue samples at BGM, and total protein content is determined by the BCA assay. Having established the protein content of these representative cell lystates, all cell pellet samples (including QC samples described in Section 1.1) were processed to cell lysates. Lysate amounts of approximately 40 μg of total protein were carried forward in the processing workflow.

C. Sample Preparation for Mass Spectrometry

Sample preparation follows standard operating procedures and constitute of the following:

Reduction and alkylation of proteins
Protein clean-up on reversed-phase column (cell pellets only)
Digestion with trypsin
iTRAQ labeling
Strong cation exchange chromatography—collection of six fractions (Agilent 1200 system)
HPLC fractionation and spotting to MALDI plates (Dionex Ultimate3000/Probot system)

D. MALDI MS and MS/MS

HPLC-MS generally employs online ESI MS/MS strategies. BG Medicine uses an off-line LC-MALDI MS/MS platform that results in better concordance of observed protein sets across the primary samples without the need of injecting the same sample multiple times. Following first pass data collection across all iTRAQ mixes, since the peptide fractions are retained on the MALDI target plates, the samples can be analyzed a second time using a targeted MS/MS acquisition pattern derived from knowledge gained during the first acquisition. In this manner, maximum observation frequency for all of the identified proteins is accomplished (ideally, every protein should be measured in every iTRAQ mix).

E. Data Processing

The data processing process within the BGM Proteomics workflow can be separated into those procedures such as preliminary peptide identification and quantification that are completed for each iTRAQ mix individually (Section 1.5.1) and those processes (Section 1.5.2) such as final assignment of peptides to proteins and final quantification of proteins, which are not completed until data acquisition is completed for the project.

The main data processing steps within the BGM Proteomics workflow are:

Peptide identification using the Mascot (Matrix Sciences) database search engine
Automated in house validation of Mascot IDs
Quantification of peptides and preliminary quantification of proteins
Expert curation of final dataset
Final assignment of peptides from each mix into a common set of proteins using the automated PVT tool
Outlier elimination and final quantification of proteins (i) Data Processing of Individual iTRAQ Mixes As each iTRAQ mix is processed through the workflow the MS/MS spectra are analyzed using proprietary BGM software tools for peptide and protein identifications, as well as initial assessment of quantification information. Based on the results of this preliminary analysis, the quality of the workflow for each primary sample in the mix is judged against a set of BGM performance metrics. If a given sample (or mix) does not pass the specified minimal performance metrics, and additional material is available, that sample is repeated in its entirety and it is data from this second implementation of the workflow that is incorporated in the final dataset.

(ii) Peptide Identification

MS/MS spectra was searched against the Uniprot protein sequence database containing human, bovine, and horse sequences augmented by common contaminant sequences such as porcine trypsin. The details of the Mascot search parameters, including the complete list of modifications, are given in Table 1.

TABLE 1

| Mascot Search Parameters | |
| --- | --- |
| Precursor mass tolerance | 100 ppm |
| Fragment mass tolerance | 0.4 Da |
| Variable modifications | N-term iTRAQ8 |
| | Lysine iTRAQ8 |
| | Cys carbamidomethyl |
| | Pyro-Glu (N-term) |
| | Pyro-Carbamidomethyl Cys (N-term) |
| | Deamidation (N only) |
| | Oxidation (M) |
| Enzyme specificity | Fully Tryptic |
| Number of missed tryptic sites allowed | 2 |
| Peptide rank considered | 1 |

After the Mascot search is complete, an auto-validation procedure is used to promote (i.e., validate) specific Mascot peptide matches. Differentiation between valid and invalid matches is based on the attained Mascot score relative to the expected Mascot score and the difference between the Rank 1 peptides and Rank 2 peptide Mascot scores. The criteria required for validation are somewhat relaxed if the peptide is one of several matched to a single protein in the iTRAQ mix or if the peptide is present in a catalogue of previously validated peptides.

(iii) Peptide and Protein Quantification

The set of validated peptides for each mix is utilized to calculate preliminary protein quantification metrics for each mix. Peptide ratios are calculated by dividing the peak area from the iTRAQ label (i.e., m/z 114, 115, 116, 118, 119, or 121) for each validated peptide by the best representation of the peak area of the reference pool (QC 1 or QC2). This peak area is the average of the 113 and 117 peaks provided both samples pass QC acceptance criteria. Preliminary protein ratios are determined by calculating the median ratio of all "useful" validated peptides matching to that protein. "Useful" peptides are fully iTRAQ labeled (all N-terminal are labeled with either Lysine or PyroGlu) and fully Cysteine labeled (i.e., all Cys residues are alkylated with Carbamidomethyl or N-terminal Pyro-cmc).

(iv) Post-Acquisition Processing

Once all passes of MS/MS data acquisition are complete for every mix in the project, the data is collated using the three steps discussed below which are aimed at enabling the results from each primary sample to be simply and meaningfully compared to that of another.

(v) Global Assignment of Peptide Sequences to Proteins

Final assignment of peptide sequences to protein accession numbers is carried out through the proprietary Protein Validation Tool (PVT). The PVT procedure determines the best, minimum non-redundant protein set to describe the entire collection of peptides identified in the project. This is an automated procedure that has been optimized to handle data from a homogeneous taxonomy.

Protein assignments for the supernatant experiments were manually curated in order to deal with the complexities of mixed taxonomies in the database. Since the automated paradigm is not valid for cell cultures grown in bovine and horse serum supplemented media, extensive manual curation is necessary to minimize the ambiguity of the source of any given protein.

(vi) Normalization of Peptide Ratios

The peptide ratios for each sample are normalized based on the method of Vandesompele et al. *Genome Biology*, 2002, 3(7), research 0034.1-11. This procedure is applied to the cell pellet measurements only. For the supernatant samples, quantitative data are not normalized considering the largest contribution to peptide identifications coming from the media.

(vii) Final Calculation of Protein Ratios

A standard statistical outlier elimination procedure is used to remove outliers from around each protein median ratio, beyond the 1.96 a level in the log-transformed data set. Following this elimination process, the final set of protein ratios are (re-)calculated.

VI. Markers of the Invention and Uses Thereof

The present invention is based, at least in part, on the identification of novel biomarkers that are associated with drug-induced toxicities, such as a drug-induced cardiotoxicity, hepatotoxicity, nephrotoxicity, neurotoxicity, renaltoxicity, or myotoxicity, or response of a drug-induced toxicity to a perturbation, such as a therapeutic agent.

In particular, the invention relates to markers (hereinafter "markers" or "markers of the invention"), which are described in the examples. The invention provides nucleic acids and proteins that are encoded by or correspond to the markers (hereinafter "marker nucleic acids" and "marker proteins," respectively). These markers are particularly useful in diagnosing drug-induced toxicity states; prognosing drug-induced toxicity states; developing drug targets for varies drug-induced toxicity states; screening for the presence of toxicity, preferably drug-induced toxicities, e.g., cardiotoxicity, hepatotoxicity, nephrotoxicity, neurotoxicity, renaltoxicity, or myotoxicity; identifying an agent that cause or is at risk for causing drug-induced toxicity; identifying an agent that can reduce or prevent drug-induced toxicity; alleviating, reducing or preventing drug-induced toxicity; and identifying markers predictive of drug-induced toxicity.

A "marker" is a gene whose altered level of expression in a tissue or cell from its expression level in normal or healthy tissue or cell is associated with a toxicity state, such as a drug-induced toxicity, e.g., cardiotoxicity. A "marker nucleic acid" is a nucleic acid (e.g., mRNA, cDNA) encoded by or corresponding to a marker of the invention. Such marker nucleic acids include DNA (e.g., cDNA) comprising the entire or a partial sequence of any of the genes that are markers of the invention or the complement of such a sequence. Such sequences are known to the one of skill in the art and can be found for example, on the NIH government pubmed website. The marker nucleic acids also include RNA comprising the entire or a partial sequence of any of the gene markers of the invention or the complement of such a sequence, wherein all thymidine residues are replaced with uridine residues. A "marker protein" is a protein encoded by or corresponding to a marker of the invention. A marker protein comprises the entire or a partial sequence of any of the marker proteins of the invention. Such sequences are known to the one of skill in the art and can be found for example, on the NIH government pubmed website. The terms "protein" and "polypeptide' are used interchangeably.

A "toxic state associated" body fluid is a fluid which, when in the body of a patient, contacts or passes through sarcoma cells or into which cells or proteins shed from sarcoma cells are capable of passing. Exemplary disease state or toxic state associated body fluids include blood fluids (e.g. whole blood, blood serum, blood having platelets removed therefrom), and are described in more detail below. Disease state or toxic state associated body fluids are not limited to, whole blood, blood having platelets removed therefrom, lymph, prostatic fluid, urine and semen.

The "normal" level of expression of a marker is the level of expression of the marker in cells of a human subject or patient not afflicted with a toxicity state.

An "over-expression" or "higher level of expression" of a marker refers to an expression level in a test sample that is greater than the standard error of the assay employed to assess expression, and is preferably at least twice, and more preferably three, four, five, six, seven, eight, nine or ten times the expression level of the marker in a control sample (e.g., sample from a healthy subject not having the marker associated a drug-induce toxicity state, e.g., cardiotoxicity, hepatotoxicity, nephrotoxicity, neurotoxicity, renaltoxicity, or myotoxicity) and preferably, the average expression level of the marker in several control samples.

A "lower level of expression" of a marker refers to an expression level in a test sample that is at least twice, and more preferably three, four, five, six, seven, eight, nine or ten times lower than the expression level of the marker in a control sample (e.g., sample from a healthy subjects not having the marker associated a drug-induced toxicity state, e.g., cardiotoxicity, cardiotoxicity, hepatotoxicity, nephrotoxicity, neurotoxicity, renaltoxicity, or myotoxicity) and preferably, the average expression level of the marker in several control samples.

A "transcribed polynucleotide" or "nucleotide transcript" is a polynucleotide (e.g. an mRNA, hnRNA, a cDNA, or an analog of such RNA or cDNA) which is complementary to or homologous with all or a portion of a mature mRNA made by transcription of a marker of the invention and normal post-transcriptional processing (e.g. splicing), if any, of the RNA transcript, and reverse transcription of the RNA transcript.

"Complementary" refers to the broad concept of sequence complementarity between regions of two nucleic acid strands or between two regions of the same nucleic acid strand. It is known that an adenine residue of a first nucleic acid region is capable of forming specific hydrogen bonds ("base pairing") with a residue of a second nucleic acid region which is antiparallel to the first region if the residue is thymine or uracil. Similarly, it is known that a cytosine residue of a first nucleic acid strand is capable of base pairing with a residue of a second nucleic acid strand which is antiparallel to the first strand if the residue is guanine. A first region of a nucleic acid is complementary to a second region of the same or a different nucleic acid if, when the two regions are arranged in an antiparallel fashion, at least one nucleotide residue of the first region is capable of base pairing with a residue of the second region. Preferably, the first region comprises a first portion and the second region comprises a second portion, whereby, when the first and second portions are arranged in an antiparallel fashion, at least about 50%, and preferably at least about 75%, at least about 90%, or at least about 95% of the nucleotide residues of the first portion are capable of base pairing with nucleotide residues in the second portion. More preferably, all nucleotide residues of the first portion are capable of base pairing with nucleotide residues in the second portion.

"Homologous" as used herein, refers to nucleotide sequence similarity between two regions of the same nucleic acid strand or between regions of two different nucleic acid strands. When a nucleotide residue position in both regions is occupied by the same nucleotide residue, then the regions are homologous at that position. A first region is homologous to a second region if at least one nucleotide residue position of each region is occupied by the same residue. Homology between two regions is expressed in terms of the proportion of nucleotide residue positions of the two regions that are occupied by the same nucleotide residue. By way of example, a region having the nucleotide sequence 5'-ATTGCC-3' and a region having the nucleotide sequence 5'-TATGGC-3' share 50% homology. Preferably, the first region comprises a first portion and the second region comprises a second portion, whereby, at least about 50%, and preferably at least about 75%, at least about 90%, or at least about 95% of the nucleotide residue positions of each of the portions are occupied by the same nucleotide residue. More preferably, all nucleotide residue positions of each of the portions are occupied by the same nucleotide residue.

"Proteins of the invention" encompass marker proteins and their fragments; variant marker proteins and their fragments; peptides and polypeptides comprising an at least 15 amino acid segment of a marker or variant marker protein; and fusion proteins comprising a marker or variant marker protein, or an at least 15 amino acid segment of a marker or variant marker protein.

The invention further provides antibodies, antibody derivatives and antibody fragments which specifically bind with the marker proteins and fragments of the marker proteins of the present invention. Unless otherwise specified herewithin, the terms "antibody" and "antibodies" broadly encompass naturally-occurring forms of antibodies (e.g., IgG, IgA, IgM, IgE) and recombinant antibodies such as single-chain antibodies, chimeric and humanized antibodies and multi-specific antibodies, as well as fragments and derivatives of all of the foregoing, which fragments and derivatives have at least an antigenic binding site. Antibody derivatives may comprise a protein or chemical moiety conjugated to an antibody.

In one embodiment, the markers of the invention are genes or proteins associated with or involved in drug-induced toxicity. Such genes or proteins involved in drug-induced toxicity include, for example, the markers listed in table 2. In some embodiments, the markers of the invention are a combination of at least two, three, four, five, six, seven, eight, nine, 10, 11, 12, 13, 14, 15, 16, 17, 18, 19, 20, 25, 30, 35, 40, 50, 60, 70, 80, 90, 100, 110, 120, 130, 140, 150, 160, or more of the foregoing genes (or proteins). All values presented in the foregoing list can also be the upper or lower limit of ranges, that are intended to be a part of this invention, e.g., between 1 and 5, 1 and 10, 1 and 20, 1 and 30, 2 and 5, 2 and 10, 5 and 10, 1 and 20, 5 and 20, 10 and 20, 10 and 25, 10 and 30 of the foregoing genes (or proteins).

A. Cardiotoxicity Associated Markers

The present invention is based, at least in part, on the identification of novel biomarkers that are associated with drug-induced cardiotoxicity. The invention is further based, at least in part, on the discovery that Coenzyme Q10 is capable of reducing or preventing drug-induced cardiotoxicity.

Accordingly, the invention provides methods for identifying an agent that causes or is at risk for causing drug-induced cardiotoxicity. In one embodiment, the agent is a drug or drug candidate. In these methods, the amount of one or more biomarkers/proteins in a pair of samples (a first sample not subject to the drug treatment, and a second sample subjected to the drug treatment) is assessed. A modulation in the level of expression of the one or more biomarkers in the second sample as compared to the first sample is an indication that the drug causes or is at risk for causing drug-induced cardiotoxicity. In one embodiment, the one or more biomarkers is selected from the markers listed in table 2. The methods of the present invention can be practiced in conjunction with any other method used by the skilled practitioner to identify a drug at risk for causing drug-induced cardiotoxocity.

Accordingly, in one aspect, the invention provides a method for identifying a drug that causes or is at risk for causing drug-induced cardiotoxicity, comprising: comparing (i) the level of expression of one or more biomarkers present in a first cell sample obtained prior to the treatment with the drug; with (ii) the level of expression of the one or more biomarkers present in a second cell sample obtained following the treatment with the drug; wherein the one or more biomarkers is selected from the markers listed in table 2; wherein a modulation in the level of expression of the one or more biomarkers in the second sample as compared to the first sample is an indication that the drug causes or is at risk for causing drug-induced cardiotoxicity.

In one embodiment, the cells are cells of the cardiovascular system, e.g., cardiomyocytes. In one embodiment, the cells are diabetic cardiomyocytes. In one embodiment, the drug is a drug or candidate drug for treating diabetes, obesity or cardiovascular disease.

In one embodiment, a modulation (e.g., an increase or a decrease) in the level of expression of one, two, three, four, five, six, seven, eight, nine, ten, eleven, twelve, thirteen, fourteen, fifteen, sixteen, seventeen, eighteen, nineteen, twenty, twenty-five, thirty, 40, 50, 60, 70, 80, 90, 100, 110, 120, 130, 140, 150, 160 or more of the biomarkers selected from the markers listed in table 2 in the second sample as compared to the first sample is an indication that the drug causes or is at risk for causing drug-induced cardiotoxicity.

In one embodiment, a modulation (e.g., an increase or a decrease) in the level of expression of a panel of two, three, four, five, six, seven, eight, nine, ten, eleven, twelve, or thirteen, markers selected from a group consisting TIMP1, PTX3, HSP76, FINC, CYB5, PAI1, IBP7 (IGFBP7), 1C17, EDIL3, HMOX1, NUCB1, CS010, HSPA4 in the second sample as compared to the first sample is an indication that the drug causes or is at risk for causing drug-induced cardiotoxicity.

Methods for identifying a rescue agent that can reduce or prevent drug-induced cardiotoxicity are also provided by the invention. In one embodiment, the drug is a drug or drug candidate for treating diabetes, obesity or a cardiovascular disorder. In these methods, the amount of one or more biomarkers in three samples (a first sample not subjected to the drug treatment, a second sample subjected to the drug treatment, and a third sample subjected both to the drug treatment and the agent) is assessed. Approximately a normalized level of expression of the one or more biomarkers, in the third sample as compared to the first sample, with a changed level of expression in the second sample, is an indication that the rescue agent can reduce or prevent drug-induced cardiotoxicity. In one embodiment, the one or more biomarkers is selected from the markers listed in table 2.

Using the methods described herein, a variety of molecules, particularly including molecules sufficiently small to be able to cross the cell membrane, may be screened in order to identify molecules which modulate, e.g., increase or decrease the expression and/or activity of a marker of the invention. Compounds so identified can be provided to a subject in order to reduce, alleviate or prevent drug-induced cardiotoxicity in the subject.

Accordingly, in another aspect, the invention provides a method for identifying an agent that can reduce or prevent drug-induced cardiotoxicity comprising: (i) determining a normal level of expression of one or more biomarkers present in a first cell sample obtained prior to the treatment with a toxicity inducing drug; (ii) determining a treated level of expression of the one or more biomarkers present in a second cell sample obtained following the treatment with the toxicity inducing drug to identify one or more biomarkers with a change of expression in the treated cell sample; (iii) determining the level of expression of the one or more biomarkers with a changed level of expression in the toxicity inducing drug treated sample present in a third cell sample obtained following the treatment with the toxicity inducing drug and the rescue agent; and (iv) comparing the level of expression of the one or more biomarkers determined in the third sample with the level of expression of the one or more biomarkers determined in the first sample; and a normalized level of expression of the one or more biomarkers in the third sample as compared to the first sample is an indication that the agent can reduce or prevent drug-induced cardiotoxicity. In one embodiment, the one or more biomarkers is selected from the markers listed in table 2.

In one embodiment, the cells are cells of the cardiovascular system, e.g., cardiomyocytes. In one embodiment, the cells are diabetic cardiomyocytes. In one embodiment, the drug is a drug or candidate drug for treating diabetes, obesity or cardiovascular disease. In one embodiment, the drug is Anthracyclines, 5-Fluorouracil, Cisplatin, Trastuzumab, Gemcitabine, Rosiglitazone, Pioglitazone, Troglitazone, Cabergoline, Pergolide, Sumatriptan, Bisphosphonates, or TNF antagonists. In one embodiment, a normalized level of expression of one, two, three, four, five, six, seven, eight, nine, ten, eleven, twelve, thirteen, fourteen, fifteen, sixteen, seventeen, eighteen, nineteen, twenty, twenty-five, thirty, 40, 50, 60, 70, 80, 90, 100, 110, 120, 130, 140, 150, 160, or more of the biomarkers selected from the markers listed in table 2 in the third sample as compared to the first sample is an indication that the rescue agent can reduce or prevent drug-induced cardiotoxicity.

In one embodiment, a normalized level of expression of a panel of two, three, four, five, six, seven, eight, nine, ten, eleven, twelve, or thirteen markers selected from a group consisting TIMP1, PTX3, HSP76, FINC, CYB5, PAI1, IBP7 (IGFBP7), 1C17, EDIL3, HMOX1, NUCB1, CS010, HSPA4, in the third sample as compared to the first sample is an indication that the rescue agent can reduce or prevent drug-induced cardiotoxicity.

In one embodiment, the sample comprises a fluid obtained from the subject. In one embodiment, the fluid is selected from the group consisting of blood fluids, vomit, saliva, lymph, cystic fluid, urine, fluids collected by bronchial lavage, fluids collected by peritoneal rinsing, and gynecological fluids. In one embodiment, the sample is a blood sample or a component thereof.

In another embodiment, the sample comprises a tissue or component thereof obtained from the subject. In one embodiment, the tissue is selected from the group consisting of bone, connective tissue, cartilage, lung, liver, kidney, muscle tissue, heart, pancreas, and skin.

In one embodiment, the subject is a human.

In one embodiment, the level of expression of the one or more markers in the biological sample is determined by assaying a transcribed polynucleotide or a portion thereof in the sample.

In one embodiment, wherein assaying the transcribed polynucleotide comprises amplifying the transcribed polynucleotide.

In one embodiment, the level of expression of the marker in the subject sample is determined by assaying a protein or a portion thereof in the sample. In one embodiment, the protein is assayed using a reagent which specifically binds with the protein.

In one embodiment, the level of expression of the one or more markers in the sample is determined using a technique selected from the group consisting of polymerase chain reaction (PCR) amplification reaction, reverse-transcriptase PCR analysis, single-strand conformation polymorphism analysis (SSCP), mismatch cleavage detection, heteroduplex analysis, Southern blot analysis, Northern blot analysis, Western blot analysis, in situ hybridization, array analysis, deoxyribonucleic acid sequencing, restriction fragment length polymorphism analysis, and combinations or subcombinations thereof, of said sample.

In one embodiment, the level of expression of the marker in the sample is determined using a technique selected from the group consisting of immunohistochemistry, immunocytochemistry, flow cytometry, ELISA and mass spectrometry.

In one embodiment, the level of expression of a plurality of markers is determined.

The invention further provides methods for alleviating, reducing or preventing drug-induced cardiotoxicity in a subject in need thereof, comprising administering to a subject (e.g., a mammal, a human, or a non-human animal) an agent identified by the screening methods provided herein, thereby reducing or preventing drug-induced cardiotoxicity in the subject. In one embodiment, the agent is administered to a subject that has already been treated with a cardiotoxicity-inducing drug. In one embodiment, the agent is administered to a subject at the same time as treatment of the subject with a cardiotoxicity-inducing drug. In one embodiment, the agent is administered to a subject prior to treatment of the subject with a cardiotoxicity-inducing drug.

The invention further provides methods for alleviating, reducing or preventing drug-induced cardiotoxicity in a subject in need thereof, comprising administering Coenzyme Q10 to the subject (e.g., a mammal, a human, or a non-human animal), thereby reducing or preventing drug-induced cardiotoxicity in the subject. In one embodiment, the Coenzyme Q10 is administered to a subject that has already been treated with a cardiotoxicity-inducing drug. In one embodiment, the Coenzyme Q10 is administered to a subject at the same time as treatment of the subject with a cardiotoxicity-inducing drug. In one embodiment, the Coenzyme Q10 is administered to a subject prior to treatment of the subject with a cardiotoxicity-inducing drug. In one embodiment, the drug-induced cardiotoxicity is associated with modulation of expression of one, two, three, four, five, six, seven, eight, nine, ten, eleven, twelve, thirteen, fourteen, fifteen, sixteen, seventeen, eighteen, nineteen, twenty, twenty-five, thirty, 40, 50, 60, 70, 80, 90, 100, 110, 120, 130, 140, 150, 160, or more of the biomarkers selected from the markers listed in table 2. All values presented in the foregoing list can also be the upper or lower limit of ranges, that are intended to be a part of this invention, e.g., between 1 and 5, 1 and 10, 2 and 5, 2 and 10, or 5 and 10 of the foregoing genes (or proteins).

In one embodiment, the drug-induced cardiotoxicity is associated with modulation of a panel of two, three, four, five, six, seven, eight, nine, ten, eleven, twelve, or thirteen markers selected from a group consisting TIMP1, PTX3, HSP76, FINC, CYB5, PAI1, IBP7 (IGFBP7), 1C17, EDIL3, HMOX1, NUCB1, CS010, HSPA4.

The invention further provides biomarkers (e.g, genes and/or proteins) that are useful as predictive markers for drug-induced cardiotoxicity. These biomarkers include the markers listed in table 2. In one embodiment, the predictive markers for drug-induced cardiotoxicity is a panel of two, three, four, five, six, seven, eight, nine, ten, eleven, twelve, or thirteen, markers selected from a group consisting TIMP1, PTX3, HSP76, FINC, CYB5, PAI1, IBP7 (IGFBP7), 1C17, EDIL3, HMOX1, NUCB1, CS010, HSPA4. The ordinary skilled artisan would, however, be able to identify additional biomarkers predictive of drug-induced cardiotoxicity by employing the methods described herein, e.g., by carrying out the methods described in Example 3 but by using a different drug known to induce cardiotoxicity. Exemplary drug-induced cardiotoxicity biomarkers of the invention are further described below.

GRP78 and GRP75 are also referred to as glucose response proteins. These proteins are associated with endo/sarcoplasmic reticulum stress (ER stress) of cardiomyocytes. SERCA, or sarcoendoplasmic reticulum calcium ATPase, regulates Ca2+ homeostasis in cardiac cells. Any disruption of these ATPase can lead to cardiac dysfunction and heart failure. Based upon the data provided herein, GRP75 and GRP78 and the edges around them are novel predictors of drug induced cardiotoxicity.

TIMP1, also referred to as TIMP metalloprotease inhibitor 1, is involved with remodeling of extra cellular matrix in association with MMPs. TIMP1 expression is correlated with fibrosis of the heart, and hypoxia of vascular endothelial cells also induces TIMP1 expression. Based upon the data provided herein, TIMP1 is a novel predictor of drug induced cardiactoxicity PTX3, also referred to as Pentraxin 3, belongs to the family of C Reactive Proteins (CRP) and is a good marker of an inflammatory condition of the heart. However, plasma PTX3 could also be representative of systemic inflammatory response due to sepsis or other medical conditions. Based upon the data provided herein, PTX3 may be a novel marker of cardiac function or cardiotoxicity. Additionally, the edges associated with PTX 3 in the network could form a novel panel of biomarkers.

HSP76, also referred to as HSPA6, is only known to be expressed in endothelial cells and B lymphocytes. There is no known role for this protein in cardiac function. Based upon the data provided herein, HSP76 may be a novel predictor of drug induced cardiotoxicity PDIA4, PDIA1, also referred to as protein disulphide isomerase family A proteins, are associated with ER stress response, like GRPs. There is no known role for these proteins in cardiac function. Based upon the data provided herein, these proteins may be novel predictors of drug induced cardiotoxicity.

CA2D1 is also referred to as calcium channel, voltage-dependent, alpha 2/delta subunit. The alpha-2/delta subunit of voltage-dependent calcium channel regulates calcium current density and activation/inactivation kinetics of the calcium channel. CA2D1 plays an important role in excitation-contraction coupling in the heart. There is no known role for this protein in cardiac function. Based upon the data provided herein, CA2D1 is a novel predictor of drug induced cardiotoxicity GPAT1 is one of four known glycerol-3-phosphate acyltransferase isoforms, and is located on the mitochondrial outer membrane, allowing reciprocal regulation with carnitine palmitoyltransferase-1. GPAT1 is upregulated transcriptionally by insulin and SREBP-1c and downregulated acutely by AMP-activated protein kinase, consistent with a role in triacylglycerol synthesis. Based upon the data provided herein, GPAT1 is a novel predictor of drug induced cardiotoxicity.

TAZ, also referred to as Tafazzin, is highly expressed in cardiac and skeletal muscle. TAZ is involved in the metabolism of cardiolipin and functions as a phospholipid-lysophospholipid transacylase. Tafazzin is responsible for remodeling of a phospholipid cardiolipin (CL), the signature lipid of the mitochondrial inner membrane. Based upon the data provided herein, TAZ is a novel predictor of drug induced cardiotoxicity Various aspects of the invention are described in further detail in the following subsections.

B. Isolated Nucleic Acid Molecules

One aspect of the invention pertains to isolated nucleic acid molecules, including nucleic acids which encode a marker protein or a portion thereof. Isolated nucleic acids of the invention also include nucleic acid molecules sufficient for use as hybridization probes to identify marker nucleic acid molecules, and fragments of marker nucleic acid molecules, e.g., those suitable for use as PCR primers for the amplification or mutation of marker nucleic acid molecules. As used herein, the term "nucleic acid molecule" is intended to include DNA molecules (e.g., cDNA or genomic DNA) and RNA molecules (e.g., mRNA) and analogs of the DNA or RNA generated using nucleotide analogs. The nucleic acid molecule can be single-stranded or double-stranded, but preferably is double-stranded DNA.

An "isolated" nucleic acid molecule is one which is separated from other nucleic acid molecules which are present in the natural source of the nucleic acid molecule. In one embodiment, an "isolated" nucleic acid molecule is free of sequences (preferably protein-encoding sequences) which naturally flank the nucleic acid (i.e., sequences located at the 5' and 3' ends of the nucleic acid) in the genomic DNA of the organism from which the nucleic acid is derived. For example, in various embodiments, the isolated nucleic acid molecule can contain less than about 5 kB, 4 kB, 3 kB, 2 kB, 1 kB, 0.5 kB or 0.1 kB of nucleotide sequences which naturally flank the nucleic acid molecule in genomic DNA of the cell from which the nucleic acid is derived. In another embodiment, an "isolated" nucleic acid molecule, such as a cDNA molecule, can be substantially free of other cellular material, or culture medium when produced by recombinant techniques, or substantially free of chemical precursors or other chemicals when chemically synthesized. A nucleic acid molecule that is substantially free of cellular material includes preparations having less than about 30%, 20%, 10%, or 5% of heterologous nucleic acid (also referred to herein as a "contaminating nucleic acid").

A nucleic acid molecule of the present invention can be isolated using standard molecular biology techniques and the sequence information in the database records described herein. Using all or a portion of such nucleic acid sequences, nucleic acid molecules of the invention can be isolated using standard hybridization and cloning techniques (e.g., as described in Sambrook et al., ed., *Molecular Cloning: A Laboratory Manual*, 2nd ed., Cold Spring Harbor Laboratory Press, Cold Spring Harbor, N.Y., 1989).

A nucleic acid molecule of the invention can be amplified using cDNA, mRNA, or genomic DNA as a template and appropriate oligonucleotide primers according to standard PCR amplification techniques. The nucleic acid so amplified can be cloned into an appropriate vector and characterized by DNA sequence analysis. Furthermore, nucleotides corresponding to all or a portion of a nucleic acid molecule of the invention can be prepared by standard synthetic techniques, e.g., using an automated DNA synthesizer.

In another preferred embodiment, an isolated nucleic acid molecule of the invention comprises a nucleic acid molecule which has a nucleotide sequence complementary to the nucleotide sequence of a marker nucleic acid or to the nucleotide sequence of a nucleic acid encoding a marker protein. A nucleic acid molecule which is complementary to a given nucleotide sequence is one which is sufficiently complementary to the given nucleotide sequence that it can hybridize to the given nucleotide sequence thereby forming a stable duplex.

Moreover, a nucleic acid molecule of the invention can comprise only a portion of a nucleic acid sequence, wherein the full length nucleic acid sequence comprises a marker nucleic acid or which encodes a marker protein. Such nucleic acids can be used, for example, as a probe or primer. The probe/primer typically is used as one or more substantially purified oligonucleotides. The oligonucleotide typically comprises a region of nucleotide sequence that hybridizes under stringent conditions to at least about 7, preferably about 15, more preferably about 25, 50, 75, 100, 125, 150, 175, 200, 250, 300, 350, or 400 or more consecutive nucleotides of a nucleic acid of the invention.

Probes based on the sequence of a nucleic acid molecule of the invention can be used to detect transcripts or genomic sequences corresponding to one or more markers of the invention. The probe comprises a label group attached thereto, e.g., a radioisotope, a fluorescent compound, an enzyme, or an enzyme co-factor. Such probes can be used as part of a diagnostic test kit for identifying cells or tissues which mis-express the protein, such as by measuring levels of a nucleic acid molecule encoding the protein in a sample of cells from a subject, e.g., detecting mRNA levels or determining whether a gene encoding the protein has been mutated or deleted.

The invention further encompasses nucleic acid molecules that differ, due to degeneracy of the genetic code, from the nucleotide sequence of nucleic acids encoding a marker protein, and thus encode the same protein.

It will be appreciated by those skilled in the art that DNA sequence polymorphisms that lead to changes in the amino acid sequence can exist within a population (e.g., the human population). Such genetic polymorphisms can exist among individuals within a population due to natural allelic variation. An allele is one of a group of genes which occur alternatively at a given genetic locus. In addition, it will be appreciated that DNA polymorphisms that affect RNA expression levels can also exist that may affect the overall expression level of that gene (e.g., by affecting regulation or degradation).

As used herein, the phrase "allelic variant" refers to a nucleotide sequence which occurs at a given locus or to a polypeptide encoded by the nucleotide sequence.

As used herein, the terms "gene" and "recombinant gene" refer to nucleic acid molecules comprising an open reading frame encoding a polypeptide corresponding to a marker of the invention. Such natural allelic variations can typically result in 1-5% variance in the nucleotide sequence of a given gene. Alternative alleles can be identified by sequencing the gene of interest in a number of different individuals. This can be readily carried out by using hybridization probes to identify the same genetic locus in a variety of individuals. Any and all such nucleotide variations and resulting amino acid polymorphisms or variations that are the result of natural allelic variation and that do not alter the functional activity are intended to be within the scope of the invention.

In another embodiment, an isolated nucleic acid molecule of the invention is at least 7, 15, 20, 25, 30, 40, 60, 80, 100, 150, 200, 250, 300, 350, 400, 450, 550, 650, 700, 800, 900, 1000, 1200, 1400, 1600, 1800, 2000, 2200, 2400, 2600, 2800, 3000, 3500, 4000, 4500, or more nucleotides in length and hybridizes under stringent conditions to a marker nucleic acid or to a nucleic acid encoding a marker protein. As used herein, the term "hybridizes under stringent conditions" is intended to describe conditions for hybridization and washing under which nucleotide sequences at least 60% (65%, 70%, preferably 75%) identical to each other typically remain hybridized to each other. Such stringent conditions are known to those skilled in the art and can be found in sections 6.3.1-6.3.6 of *Current Protocols in Molecular Biology*, John Wiley & Sons, N.Y. (1989). A preferred, non-limiting example of stringent hybridization conditions are hybridization in 6× sodium chloride/sodium citrate (SSC) at about 45° C., followed by one or more washes in 0.2×SSC, 0.1% SDS at 50-65° C.

In addition to naturally-occurring allelic variants of a nucleic acid molecule of the invention that can exist in the population, the skilled artisan will further appreciate that sequence changes can be introduced by mutation thereby leading to changes in the amino acid sequence of the encoded protein, without altering the biological activity of the protein encoded thereby. For example, one can make nucleotide substitutions leading to amino acid substitutions at "non-essential" amino acid residues. A "non-essential" amino acid residue is a residue that can be altered from the wild-type sequence without altering the biological activity, whereas an "essential" amino acid residue is required for biological activity. For example, amino acid residues that are not conserved or only semi-conserved among homologs of various species may be non-essential for activity and thus would be likely targets for alteration. Alternatively, amino acid residues that are conserved among the homologs of various species (e.g., murine and human) may be essential for activity and thus would not be likely targets for alteration.

Accordingly, another aspect of the invention pertains to nucleic acid molecules encoding a variant marker protein that contain changes in amino acid residues that are not essential for activity. Such variant marker proteins differ in amino acid sequence from the naturally-occurring marker proteins, yet retain biological activity. In one embodiment, such a variant marker protein has an amino acid sequence that is at least about 40% identical, 50%, 60%, 70%, 80%, 90%, 91%, 92%, 93%, 94%, 95%, 96%, 97%, 98% or 99% identical to the amino acid sequence of a marker protein.

An isolated nucleic acid molecule encoding a variant marker protein can be created by introducing one or more nucleotide substitutions, additions or deletions into the nucleotide sequence of marker nucleic acids, such that one or more amino acid residue substitutions, additions, or deletions are introduced into the encoded protein. Mutations can be introduced by standard techniques, such as site-directed mutagenesis and PCR-mediated mutagenesis. Preferably, conservative amino acid substitutions are made at one or more predicted non-essential amino acid residues. A "conservative amino acid substitution" is one in which the amino acid residue is replaced with an amino acid residue having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), non-polar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine). Alternatively, mutations can be introduced randomly along all or part of the coding sequence, such as by saturation mutagenesis, and the resultant mutants can be screened for biological activity to identify mutants that retain activity. Following mutagenesis, the encoded protein can be expressed recombinantly and the activity of the protein can be determined.

The present invention encompasses antisense nucleic acid molecules, i.e., molecules which are complementary to a sense nucleic acid of the invention, e.g., complementary to the coding strand of a double-stranded marker cDNA molecule or complementary to a marker mRNA sequence. Accordingly, an antisense nucleic acid of the invention can hydrogen bond to (i.e. anneal with) a sense nucleic acid of the invention. The antisense nucleic acid can be complementary to an entire coding strand, or to only a portion thereof, e.g., all or part of the protein coding region (or open reading frame). An antisense nucleic acid molecule can also be antisense to all or part of a non-coding region of the coding strand of a nucleotide sequence encoding a marker protein. The non-coding regions ("5' and 3' untranslated regions") are the 5' and 3' sequences which flank the coding region and are not translated into amino acids.

An antisense oligonucleotide can be, for example, about 5, 10, 15, 20, 25, 30, 35, 40, 45, or 50 or more nucleotides in length. An antisense nucleic acid of the invention can be constructed using chemical synthesis and enzymatic ligation reactions using procedures known in the art. For example, an antisense nucleic acid (e.g., an antisense oligonucleotide) can be chemically synthesized using naturally occurring nucleotides or variously modified nucleotides designed to increase the biological stability of the molecules or to increase the physical stability of the duplex formed between the antisense and sense nucleic acids, e.g., phosphorothioate derivatives and acridine substituted nucleotides can be used. Examples of modified nucleotides which can be used to generate the antisense nucleic acid include 5-fluorouracil, 5-bromouracil, 5-chlorouracil, 5-iodouracil, hypoxanthine, xanthine, 4-acetylcytosine, 5-(carboxyhydroxylmethyl) uracil, 5-carboxymethylaminomethyl-2-thiouridine, 5-carboxymethylaminomethyluracil, dihydrouracil, beta-D-galactosylqueosine, inosine, N6-isopentenyladenine, 1-methylguanine, 1-methylinosine, 2,2-dimethylguanine, 2-methyladenine, 2-methylguanine, 3-methylcytosine, 5-methylcytosine, N6-adenine, 7-methylguanine, 5-methylaminomethyluracil, 5-methoxyaminomethyl-2-thiouracil, beta-D-mannosylqueosine, 5'-methoxycarboxymethyluracil, 5-methoxyuracil, 2-methylthio-N6-isopentenyladenine, uracil-5-oxyacetic acid (v), wybutoxosine, pseudouracil, queosine, 2-thiocytosine, 5-methyl-2-thiouracil, 2-thiouracil, 4-thiouracil, 5-methyluracil, uracil-5-oxyacetic acid methylester, uracil-5-oxyacetic acid (v), 5-methyl-2-thiouracil, 3-(3-amino-3-N-2-carboxypropyl) uracil, (acp3)w, and 2,6-diaminopurine. Alternatively, the antisense nucleic acid can be produced biologically using an expression vector into which a nucleic acid has been sub-cloned in an antisense orientation (i.e., RNA transcribed from the inserted nucleic acid will be of an antisense orientation to a target nucleic acid of interest, described further in the following subsection).

The antisense nucleic acid molecules of the invention are typically administered to a subject or generated in situ such that they hybridize with or bind to cellular mRNA and/or genomic DNA encoding a marker protein to thereby inhibit expression of the marker, e.g., by inhibiting transcription and/or translation. The hybridization can be by conventional nucleotide complementarity to form a stable duplex, or, for example, in the case of an antisense nucleic acid molecule which binds to DNA duplexes, through specific interactions in the major groove of the double helix. Examples of a route of administration of antisense nucleic acid molecules of the invention includes direct injection at a tissue site or infusion of the antisense nucleic acid into toxicity state associated body fluid. Alternatively, antisense nucleic acid molecules can be modified to target selected cells and then administered systemically. For example, for systemic administration, antisense molecules can be modified such that they specifically bind to receptors or antigens expressed on a selected cell surface, e.g., by linking the antisense nucleic acid molecules to peptides or antibodies which bind to cell surface receptors or antigens. The antisense nucleic acid molecules can also be delivered to cells using the vectors described herein. To achieve sufficient intracellular concentrations of the antisense molecules, vector constructs in which the antisense nucleic acid molecule is placed under the control of a strong pol II or pol III promoter are preferred.

An antisense nucleic acid molecule of the invention can be an α-anomeric nucleic acid molecule. An α-anomeric nucleic acid molecule forms specific double-stranded hybrids with complementary RNA in which, contrary to the usual α-units, the strands run parallel to each other (Gaultier et al., 1987, *Nucleic Acids Res.* 15:6625-6641). The antisense nucleic acid molecule can also comprise a 2'-o-methylribonucleotide (Inoue et al., 1987, *Nucleic Acids Res.* 15:6131-6148) or a chimeric RNA-DNA analogue (Inoue et al., 1987, *FEBS Lett.* 215:327-330).

The invention also encompasses ribozymes. Ribozymes are catalytic RNA molecules with ribonuclease activity which are capable of cleaving a single-stranded nucleic acid, such as an mRNA, to which they have a complementary region. Thus, ribozymes (e.g., hammerhead ribozymes as described in Haselhoff and Gerlach, 1988, *Nature* 334:585-591) can be used to catalytically cleave mRNA transcripts to thereby inhibit translation of the protein encoded by the mRNA. A ribozyme having specificity for a nucleic acid molecule encoding a marker protein can be designed based upon the nucleotide sequence of a cDNA corresponding to the marker. For example, a derivative of a *Tetrahymena* L-19 IVS RNA can be constructed in which the nucleotide sequence of the active site is complementary to the nucleotide sequence to be cleaved (see Cech et al. U.S. Pat. No. 4,987,071; and Cech et al. U.S. Pat. No. 5,116,742). Alternatively, an mRNA encoding a polypeptide of the invention can be used to select a catalytic RNA having a specific ribonuclease activity from a pool of RNA molecules (see, e.g., Bartel and Szostak, 1993, *Science* 261:1411-1418).

The invention also encompasses nucleic acid molecules which form triple helical structures. For example, expression of a marker of the invention can be inhibited by targeting nucleotide sequences complementary to the regulatory region of the gene encoding the marker nucleic acid or protein (e.g., the promoter and/or enhancer) to form triple helical structures that prevent transcription of the gene in target cells. See generally Helene (1991) *Anticancer Drug Des.* 6(6):569-84; Helene (1992) *Ann. N.Y. Acad. Sci.* 660: 27-36; and Maher (1992) *Bioassays* 14(12):807-15.

In various embodiments, the nucleic acid molecules of the invention can be modified at the base moiety, sugar moiety or phosphate backbone to improve, e.g., the stability, hybridization, or solubility of the molecule. For example, the deoxyribose phosphate backbone of the nucleic acids can be modified to generate peptide nucleic acids (see Hyrup et al., 1996, *Bioorganic & Medicinal Chemistry* 4(1): 5-23). As used herein, the terms "peptide nucleic acids" or "PNAs" refer to nucleic acid mimics, e.g., DNA mimics, in which the deoxyribose phosphate backbone is replaced by a pseudopeptide backbone and only the four natural nucleobases are retained. The neutral backbone of PNAs has been shown to allow for specific hybridization to DNA and RNA under conditions of low ionic strength. The synthesis of PNA oligomers can be performed using standard solid phase peptide synthesis protocols as described in Hyrup et al. (1996), supra; Perry-O'Keefe et al. (1996) *Proc. Natl. Acad. Sci. USA* 93:14670-675.

PNAs can be used in therapeutic and diagnostic applications. For example, PNAs can be used as antisense or antigene agents for sequence-specific modulation of gene expression by, e.g., inducing transcription or translation arrest or inhibiting replication. PNAs can also be used, e.g., in the analysis of single base pair mutations in a gene by, e.g., PNA directed PCR clamping; as artificial restriction enzymes when used in combination with other enzymes, e.g., S1 nucleases (Hyrup (1996), supra; or as probes or primers for DNA sequence and hybridization (Hyrup, 1996, supra; Perry-O'Keefe et al., 1996, *Proc. Natl. Acad. Sci. USA* 93:14670-675).

In another embodiment, PNAs can be modified, e.g., to enhance their stability or cellular uptake, by attaching lipophilic or other helper groups to PNA, by the formation of PNA-DNA chimeras, or by the use of liposomes or other techniques of drug delivery known in the art. For example, PNA-DNA chimeras can be generated which can combine the advantageous properties of PNA and DNA. Such chimeras allow DNA recognition enzymes, e.g., RNase H and DNA polymerases, to interact with the DNA portion while the PNA portion would provide high binding affinity and specificity. PNA-DNA chimeras can be linked using linkers of appropriate lengths selected in terms of base stacking, number of bonds between the nucleobases, and orientation (Hyrup, 1996, supra). The synthesis of PNA-DNA chimeras can be performed as described in Hyrup (1996), supra, and Finn et al. (1996) *Nucleic Acids Res.* 24(17):3357-63. For example, a DNA chain can be synthesized on a solid support using standard phosphoramidite coupling chemistry and modified nucleoside analogs. Compounds such as 5'-(4-methoxytrityl)amino-5'-deoxy-thymidine phosphoramidite can be used as a link between the PNA and the 5' end of DNA (Mag et al., 1989, *Nucleic Acids Res.* 17:5973-88). PNA monomers are then coupled in a step-wise manner to produce a chimeric molecule with a 5' PNA segment and a 3' DNA segment (Finn et al., 1996, *Nucleic Acids Res.* 24(17):3357-63). Alternatively, chimeric molecules can be synthesized with a 5' DNA segment and a 3' PNA segment (Peterser et al., 1975, *Bioorganic Med. Chem. Lett.* 5:1119-11124).

In other embodiments, the oligonucleotide can include other appended groups such as peptides (e.g., for targeting host cell receptors in vivo), or agents facilitating transport across the cell membrane (see, e.g., Letsinger et al., 1989, *Proc. Natl. Acad. Sci. USA* 86:6553-6556; Lemaitre et al., 1987, *Proc. Natl. Acad. Sci. USA* 84:648-652; PCT Publication No. WO 88/09810) or the blood-brain barrier (see, e.g., PCT Publication No. WO 89/10134). In addition, oligonucleotides can be modified with hybridization-triggered cleavage agents (see, e.g., Krol et al., 1988, *Bio/Techniques* 6:958-976) or intercalating agents (see, e.g., Zon, 1988, *Pharm. Res.* 5:539-549). To this end, the oligonucleotide can be conjugated to another molecule, e.g., a peptide, hybridization triggered cross-linking agent, transport agent, hybridization-triggered cleavage agent, etc.

The invention also includes molecular beacon nucleic acids having at least one region which is complementary to a nucleic acid of the invention, such that the molecular beacon is useful for quantitating the presence of the nucleic acid of the invention in a sample. A "molecular beacon" nucleic acid is a nucleic acid comprising a pair of complementary regions and having a fluorophore and a fluorescent quencher associated therewith. The fluorophore and quencher are associated with different portions of the nucleic acid in such an orientation that when the complementary regions are annealed with one another, fluorescence of the fluorophore is quenched by the quencher. When the complementary regions of the nucleic acid are not annealed with one another, fluorescence of the fluorophore is quenched to a lesser degree. Molecular beacon nucleic acids are described, for example, in U.S. Pat. No. 5,876,930.

C. Isolated Proteins and Antibodies

One aspect of the invention pertains to isolated marker proteins and biologically active portions thereof, as well as polypeptide fragments suitable for use as immunogens to raise antibodies directed against a marker protein or a fragment thereof. In one embodiment, the native marker protein can be isolated from cells or tissue sources by an appropriate purification scheme using standard protein purification techniques. In another embodiment, a protein or peptide comprising the whole or a segment of the marker protein is produced by recombinant DNA techniques. Alternative to recombinant expression, such protein or peptide can be synthesized chemically using standard peptide synthesis techniques.

An "isolated" or "purified" protein or biologically active portion thereof is substantially free of cellular material or other contaminating proteins from the cell or tissue source from which the protein is derived, or substantially free of chemical precursors or other chemicals when chemically synthesized. The language "substantially free of cellular material" includes preparations of protein in which the protein is separated from cellular components of the cells from which it is isolated or recombinantly produced. Thus, protein that is substantially free of cellular material includes preparations of protein having less than about 30%, 20%, 10%, or 5% (by dry weight) of heterologous protein (also referred to herein as a "contaminating protein"). When the protein or biologically active portion thereof is recombinantly produced, it is also preferably substantially free of culture medium, i.e., culture medium represents less than about 20%, 10%, or 5% of the volume of the protein preparation. When the protein is produced by chemical synthesis, it is preferably substantially free of chemical precursors or other chemicals, i.e., it is separated from chemical precursors or other chemicals which are involved in the synthesis of the protein. Accordingly such preparations of the protein have less than about 30%, 20%, 10%, 5% (by dry weight) of chemical precursors or compounds other than the polypeptide of interest.

Biologically active portions of a marker protein include polypeptides comprising amino acid sequences sufficiently identical to or derived from the amino acid sequence of the marker protein, which include fewer amino acids than the full length protein, and exhibit at least one activity of the corresponding full-length protein. Typically, biologically active portions comprise a domain or motif with at least one activity of the corresponding full-length protein. A biologically active portion of a marker protein of the invention can be a polypeptide which is, for example, 10, 25, 50, 100 or more amino acids in length. Moreover, other biologically active portions, in which other regions of the marker protein are deleted, can be prepared by recombinant techniques and evaluated for one or more of the functional activities of the native form of the marker protein.

Preferred marker proteins are encoded by nucleotide sequences comprising the sequences encoding any of the genes described in the examples. Other useful proteins are substantially identical (e.g., at least about 40%, preferably 50%, 60%, 70%, 80%, 90%, 91%, 92%, 93%, 94%, 95%, 96%, 97%, 98% or 99%) to one of these sequences and retain the functional activity of the corresponding naturally-occurring marker protein yet differ in amino acid sequence due to natural allelic variation or mutagenesis.

To determine the percent identity of two amino acid sequences or of two nucleic acids, the sequences are aligned for optimal comparison purposes (e.g., gaps can be introduced in the sequence of a first amino acid or nucleic acid sequence for optimal alignment with a second amino or nucleic acid sequence). The amino acid residues or nucleotides at corresponding amino acid positions or nucleotide positions are then compared. When a position in the first sequence is occupied by the same amino acid residue or nucleotide as the corresponding position in the second sequence, then the molecules are identical at that position. Preferably, the percent identity between the two sequences is calculated using a global alignment. Alternatively, the percent identity between the two sequences is calculated using a local alignment. The percent identity between the two sequences is a function of the number of identical positions shared by the sequences (i.e., % identity=# of identical positions/total # of positions (e.g., overlapping positions)×100). In one embodiment the two sequences are the same length. In another embodiment, the two sequences are not the same length.

The determination of percent identity between two sequences can be accomplished using a mathematical algorithm. A preferred, non-limiting example of a mathematical algorithm utilized for the comparison of two sequences is the algorithm of Karlin and Altschul (1990) *Proc. Natl. Acad. Sci. USA* 87:2264-2268, modified as in Karlin and Altschul (1993) *Proc. Natl. Acad. Sci. USA* 90:5873-5877. Such an algorithm is incorporated into the BLASTN and BLASTX programs of Altschul, et al. (1990) *J. Mol. Biol.* 215:403-410. BLAST nucleotide searches can be performed with the BLASTN program, score=100, wordlength=12 to obtain nucleotide sequences homologous to a nucleic acid molecules of the invention. BLAST protein searches can be performed with the BLASTP program, score=50, wordlength=3 to obtain amino acid sequences homologous to a protein molecules of the invention. To obtain gapped alignments for comparison purposes, a newer version of the BLAST algorithm called Gapped BLAST can be utilized as described in Altschul et al. (1997) *Nucleic Acids Res.* 25:3389-3402, which is able to perform gapped local alignments for the programs BLASTN, BLASTP and BLASTX. Alternatively, PSI-Blast can be used to perform an iterated search which detects distant relationships between molecules. When utilizing BLAST, Gapped BLAST, and PSI-Blast programs, the default parameters of the respective programs (e.g., BLASTX and BLASTN) can be used. See http://www.ncbi.nlm.nih.gov. Another preferred, non-limiting example of a mathematical algorithm utilized for the comparison of sequences is the algorithm of Myers and Miller, (1988) *CABIOS* 4:11-17. Such an algorithm is incorporated into the ALIGN program (version 2.0) which is part of the GCG sequence alignment software package. When utilizing the ALIGN program for comparing amino acid sequences, a PAM 120 weight residue table, a gap length penalty of 12, and a gap penalty of 4 can be used. Yet another useful algorithm for identifying regions of local sequence similarity and alignment is the FASTA algorithm as described in Pearson and Lipman (1988) *Proc. Natl. Acad. Sci. USA* 85:2444-2448. When using the FASTA algorithm for comparing nucleotide or amino acid sequences, a PAM 120 weight residue table can, for example, be used with a k-tuple value of 2.

The percent identity between two sequences can be determined using techniques similar to those described above, with or without allowing gaps. In calculating percent identity, only exact matches are counted.

The invention also provides chimeric or fusion proteins comprising a marker protein or a segment thereof. As used herein, a "chimeric protein" or "fusion protein" comprises all or part (preferably a biologically active part) of a marker protein operably linked to a heterologous polypeptide (i.e., a polypeptide other than the marker protein). Within the fusion protein, the term "operably linked" is intended to indicate that the marker protein or segment thereof and the heterologous polypeptide are fused in-frame to each other. The heterologous polypeptide can be fused to the amino-terminus or the carboxyl-terminus of the marker protein or segment.

One useful fusion protein is a GST fusion protein in which a marker protein or segment is fused to the carboxyl terminus of GST sequences. Such fusion proteins can facilitate the purification of a recombinant polypeptide of the invention.

In another embodiment, the fusion protein contains a heterologous signal sequence at its amino terminus. For example, the native signal sequence of a marker protein can be removed and replaced with a signal sequence from another protein. For example, the gp67 secretory sequence of the baculovirus envelope protein can be used as a heterologous signal sequence (Ausubel et al., ed., *Current Protocols in Molecular Biology*, John Wiley & Sons, N Y, 1992). Other examples of eukaryotic heterologous signal sequences include the secretory sequences of melittin and human placental alkaline phosphatase (Stratagene; La Jolla, Calif.). In yet another example, useful prokaryotic heterologous signal sequences include the phoA secretory signal (Sambrook et al., supra) and the protein A secretory signal (Pharmacia Biotech; Piscataway, N.J.).

In yet another embodiment, the fusion protein is an immunoglobulin fusion protein in which all or part of a marker protein is fused to sequences derived from a member of the immunoglobulin protein family. The immunoglobulin fusion proteins of the invention can be incorporated into pharmaceutical compositions and administered to a subject to inhibit an interaction between a ligand (soluble or membrane-bound) and a protein on the surface of a cell (receptor), to thereby suppress signal transduction in vivo. The immunoglobulin fusion protein can be used to affect the bioavailability of a cognate ligand of a marker protein. Inhibition of ligand/receptor interaction can be useful therapeutically, both for treating proliferative and differentiative disorders and for modulating (e.g. promoting or inhibiting) cell survival. Moreover, the immunoglobulin fusion proteins of the invention can be used as immunogens to produce antibodies directed against a marker protein in a subject, to purify ligands and in screening assays to identify molecules which inhibit the interaction of the marker protein with ligands.

Chimeric and fusion proteins of the invention can be produced by standard recombinant DNA techniques. In another embodiment, the fusion gene can be synthesized by conventional techniques including automated DNA synthesizers. Alternatively, PCR amplification of gene fragments can be carried out using anchor primers which give rise to complementary overhangs between two consecutive gene fragments which can subsequently be annealed and re-amplified to generate a chimeric gene sequence (see, e.g., Ausubel et al., supra). Moreover, many expression vectors are commercially available that already encode a fusion moiety (e.g., a GST polypeptide). A nucleic acid encoding a polypeptide of the invention can be cloned into such an expression vector such that the fusion moiety is linked in-frame to the polypeptide of the invention.

A signal sequence can be used to facilitate secretion and isolation of marker proteins. Signal sequences are typically characterized by a core of hydrophobic amino acids which are generally cleaved from the mature protein during secretion in one or more cleavage events. Such signal peptides contain processing sites that allow cleavage of the signal sequence from the mature proteins as they pass through the secretory pathway. Thus, the invention pertains to marker proteins, fusion proteins or segments thereof having a signal sequence, as well as to such proteins from which the signal sequence has been proteolytically cleaved (i.e., the cleavage products). In one embodiment, a nucleic acid sequence encoding a signal sequence can be operably linked in an expression vector to a protein of interest, such as a marker protein or a segment thereof. The signal sequence directs secretion of the protein, such as from a eukaryotic host into which the expression vector is transformed, and the signal sequence is subsequently or concurrently cleaved. The protein can then be readily purified from the extracellular medium by art recognized methods. Alternatively, the signal sequence can be linked to the protein of interest using a sequence which facilitates purification, such as with a GST domain.

The present invention also pertains to variants of the marker proteins. Such variants have an altered amino acid sequence which can function as either agonists (mimetics) or as antagonists. Variants can be generated by mutagenesis, e.g., discrete point mutation or truncation. An agonist can retain substantially the same, or a subset, of the biological activities of the naturally occurring form of the protein. An antagonist of a protein can inhibit one or more of the activities of the naturally occurring form of the protein by, for example, competitively binding to a downstream or upstream member of a cellular signaling cascade which includes the protein of interest. Thus, specific biological effects can be elicited by treatment with a variant of limited function. Treatment of a subject with a variant having a subset of the biological activities of the naturally occurring form of the protein can have fewer side effects in a subject relative to treatment with the naturally occurring form of the protein.

Variants of a marker protein which function as either agonists (mimetics) or as antagonists can be identified by screening combinatorial libraries of mutants, e.g., truncation mutants, of the protein of the invention for agonist or antagonist activity. In one embodiment, a variegated library of variants is generated by combinatorial mutagenesis at the nucleic acid level and is encoded by a variegated gene library. A variegated library of variants can be produced by, for example, enzymatically ligating a mixture of synthetic oligonucleotides into gene sequences such that a degenerate set of potential protein sequences is expressible as individual polypeptides, or alternatively, as a set of larger fusion proteins (e.g., for phage display). There are a variety of methods which can be used to produce libraries of potential variants of the marker proteins from a degenerate oligonucleotide sequence. Methods for synthesizing degenerate oligonucleotides are known in the art (see, e.g., Narang, 1983, *Tetrahedron* 39:3; Itakura et al., 1984, *Annu. Rev. Biochem.* 53:323; Itakura et al., 1984, *Science* 198:1056; Ike et al., 1983 *Nucleic Acid Res.* 11:477).

In addition, libraries of segments of a marker protein can be used to generate a variegated population of polypeptides for screening and subsequent selection of variant marker proteins or segments thereof. For example, a library of coding sequence fragments can be generated by treating a double stranded PCR fragment of the coding sequence of interest with a nuclease under conditions wherein nicking occurs only about once per molecule, denaturing the double stranded DNA, renaturing the DNA to form double stranded DNA which can include sense/antisense pairs from different nicked products, removing single stranded portions from reformed duplexes by treatment with S1 nuclease, and ligating the resulting fragment library into an expression vector. By this method, an expression library can be derived which encodes amino terminal and internal fragments of various sizes of the protein of interest.

Several techniques are known in the art for screening gene products of combinatorial libraries made by point mutations or truncation, and for screening cDNA libraries for gene products having a selected property. The most widely used techniques, which are amenable to high through-put analysis, for screening large gene libraries typically include cloning the gene library into replicable expression vectors, transforming appropriate cells with the resulting library of vectors, and expressing the combinatorial genes under conditions in which detection of a desired activity facilitates isolation of the vector encoding the gene whose product was detected. Recursive ensemble mutagenesis (REM), a technique which enhances the frequency of functional mutants in the libraries, can be used in combination with the screening assays to identify variants of a protein of the invention (Arkin and Yourvan, 1992, *Proc. Natl. Acad. Sci. USA* 89:7811-7815; Delgrave et al., 1993, *Protein Engineering* 6(3):327-331).

Another aspect of the invention pertains to antibodies directed against a protein of the invention. In preferred embodiments, the antibodies specifically bind a marker protein or a fragment thereof. The terms "antibody" and "antibodies" as used interchangeably herein refer to immunoglobulin molecules as well as fragments and derivatives thereof that comprise an immunologically active portion of an immunoglobulin molecule, (i.e., such a portion contains an antigen binding site which specifically binds an antigen, such as a marker protein, e.g., an epitope of a marker protein). An antibody which specifically binds to a protein of the invention is an antibody which binds the protein, but does not substantially bind other molecules in a sample, e.g., a biological sample, which naturally contains the protein. Examples of an immunologically active portion of an immunoglobulin molecule include, but are not limited to, single-chain antibodies (scAb), F(ab) and F(ab')$_2$ fragments.

An isolated protein of the invention or a fragment thereof can be used as an immunogen to generate antibodies. The full-length protein can be used or, alternatively, the invention provides antigenic peptide fragments for use as immunogens. The antigenic peptide of a protein of the invention comprises at least 8 (preferably 10, 15, 20, or 30 or more) amino acid residues of the amino acid sequence of one of the proteins of the invention, and encompasses at least one epitope of the protein such that an antibody raised against the peptide forms a specific immune complex with the protein. Preferred epitopes encompassed by the antigenic peptide are regions that are located on the surface of the protein, e.g., hydrophilic regions. Hydrophobicity sequence analysis, hydrophilicity sequence analysis, or similar analyses can be used to identify hydrophilic regions. In preferred embodiments, an isolated marker protein or fragment thereof is used as an immunogen.

An immunogen typically is used to prepare antibodies by immunizing a suitable (i.e. immunocompetent) subject such as a rabbit, goat, mouse, or other mammal or vertebrate. An appropriate immunogenic preparation can contain, for example, recombinantly-expressed or chemically-synthesized protein or peptide. The preparation can further include an adjuvant, such as Freund's complete or incomplete adjuvant, or a similar immunostimulatory agent. Preferred immunogen compositions are those that contain no other human proteins such as, for example, immunogen compositions made using a non-human host cell for recombinant expression of a protein of the invention. In such a manner, the resulting antibody compositions have reduced or no binding of human proteins other than a protein of the invention.

The invention provides polyclonal and monoclonal antibodies. The term "monoclonal antibody" or "monoclonal antibody composition", as used herein, refers to a population of antibody molecules that contain only one species of an antigen binding site capable of immunoreacting with a particular epitope. Preferred polyclonal and monoclonal antibody compositions are ones that have been selected for antibodies directed against a protein of the invention. Particularly preferred polyclonal and monoclonal antibody preparations are ones that contain only antibodies directed against a marker protein or fragment thereof.

Polyclonal antibodies can be prepared by immunizing a suitable subject with a protein of the invention as an immunogen. The antibody titer in the immunized subject can be monitored over time by standard techniques, such as with an enzyme linked immunosorbent assay (ELISA) using immobilized polypeptide. At an appropriate time after immunization, e.g., when the specific antibody titers are highest, antibody-producing cells can be obtained from the subject and used to prepare monoclonal antibodies (mAb) by standard techniques, such as the hybridoma technique originally described by Kohler and Milstein (1975) *Nature* 256:495-497, the human B cell hybridoma technique (see Kozbor et al., 1983, *Immunol. Today* 4:72), the EBV-hybridoma technique (see Cole et al., pp. 77-96 In *Monoclonal Antibodies and Cancer Therapy*, Alan R. Liss, Inc., 1985) or trioma techniques. The technology for producing hybridomas is well known (see generally *Current Protocols in Immunology*, Coligan et al. ed., John Wiley & Sons, New York, 1994). Hybridoma cells producing a monoclonal antibody of the invention are detected by screening the hybridoma culture supernatants for antibodies that bind the polypeptide of interest, e.g., using a standard ELISA assay.

Alternative to preparing monoclonal antibody-secreting hybridomas, a monoclonal antibody directed against a protein of the invention can be identified and isolated by screening a recombinant combinatorial immunoglobulin library (e.g., an antibody phage display library) with the polypeptide of interest. Kits for generating and screening phage display libraries are commercially available (e.g., the Pharmacia *Recombinant Phage Antibody System*, Catalog No. 27-9400-01; and the Stratagene *SurfZAP Phage Display Kit*, Catalog No. 240612). Additionally, examples of methods and reagents particularly amenable for use in generating and screening antibody display library can be found in, for example, U.S. Pat. No. 5,223,409; PCT Publication No. WO 92/18619; PCT Publication No. WO 91/17271; PCT Publication No. WO 92/20791; PCT Publication No. WO 92/15679; PCT Publication No. WO 93/01288; PCT Publication No. WO 92/01047; PCT Publication No. WO 92/09690; PCT Publication No. WO 90/02809; Fuchs et al. (1991) *Bio/Technology* 9:1370-1372; Hay et al. (1992) *Hum. Antibod. Hybridomas* 3:81-85; Huse et al. (1989) *Science* 246:1275-1281; Griffiths et al. (1993) *EMBO J.* 12:725-734.

The invention also provides recombinant antibodies that specifically bind a protein of the invention. In preferred embodiments, the recombinant antibodies specifically binds a marker protein or fragment thereof. Recombinant antibodies include, but are not limited to, chimeric and humanized monoclonal antibodies, comprising both human and non-human portions, single-chain antibodies and multi-specific antibodies. A chimeric antibody is a molecule in which different portions are derived from different animal species, such as those having a variable region derived from a murine mAb and a human immunoglobulin constant region. (See, e.g., Cabilly et al., U.S. Pat. No. 4,816,567; and Boss et al., U.S. Pat. No. 4,816,397, which are incorporated herein by reference in their entirety.) Single-chain antibodies have an antigen binding site and consist of a single polypeptide. They can be produced by techniques known in the art, for example using methods described in Ladner et. al U.S. Pat. No. 4,946,778 (which is incorporated herein by reference in its entirety); Bird et al., (1988) *Science* 242:423-426; Whitlow et al., (1991) *Methods in Enzymology* 2:1-9; Whitlow et al., (1991) *Methods in Enzymology* 2:97-105; and Huston et al., (1991) *Methods in Enzymology Molecular Design and Modeling: Concepts and Applications* 203:46-88. Multi-specific antibodies are antibody molecules having at least two antigen-binding sites that specifically bind different antigens. Such molecules can be produced by techniques known in the art, for example using methods described in Segal, U.S. Pat. No. 4,676,980 (the disclosure of which is incorporated herein by reference in its entirety); Holliger et al., (1993) *Proc. Natl. Acad. Sci. USA* 90:6444-6448; Whitlow et al., (1994) *Protein Eng.* 7:1017-1026 and U.S. Pat. No. 6,121,424.

Humanized antibodies are antibody molecules from non-human species having one or more complementarity determining regions (CDRs) from the non-human species and a framework region from a human immunoglobulin molecule. (See, e.g., Queen, U.S. Pat. No. 5,585,089, which is incorporated herein by reference in its entirety.) Humanized monoclonal antibodies can be produced by recombinant DNA techniques known in the art, for example using methods described in PCT Publication No. WO 87/02671; European Patent Application 184,187; European Patent Application 171,496; European Patent Application 173,494; PCT Publication No. WO 86/01533; U.S. Pat. No. 4,816,567; European Patent Application 125,023; Better et al. (1988) *Science* 240:1041-1043; Liu et al. (1987) *Proc. Natl. Acad. Sci. USA* 84:3439-3443; Liu et al. (1987) *J. Immunol.* 139:3521-3526; Sun et al. (1987) *Proc. Natl. Acad. Sci. USA* 84:214-218; Nishimura et al. (1987) *Cancer Res.* 47:999-1005; Wood et al. (1985) *Nature* 314:446-449; and Shaw et al. (1988) *J. Natl. Cancer Inst.* 80:1553-1559); Morrison (1985) *Science* 229:1202-1207; Oi et al. (1986) *Bio/Techniques* 4:214; U.S. Pat. No. 5,225,539; Jones et al. (1986) *Nature* 321:552-525; Verhoeyan et al. (1988) *Science* 239:1534; and Beidler et al. (1988) *J. Immunol.* 141:4053-4060.

More particularly, humanized antibodies can be produced, for example, using transgenic mice which are incapable of expressing endogenous immunoglobulin heavy and light chains genes, but which can express human heavy and light chain genes. The transgenic mice are immunized in the normal fashion with a selected antigen, e.g., all or a portion of a polypeptide corresponding to a marker of the invention. Monoclonal antibodies directed against the antigen can be obtained using conventional hybridoma technology. The human immunoglobulin transgenes harbored by the transgenic mice rearrange during B cell differentiation, and subsequently undergo class switching and somatic mutation. Thus, using such a technique, it is possible to produce therapeutically useful IgG, IgA and IgE antibodies. For an overview of this technology for producing human antibodies, see Lonberg and Huszar (1995) *Int. Rev. Immunol.* 13:65-93). For a detailed discussion of this technology for producing human antibodies and human monoclonal antibodies and protocols for producing such antibodies, see, e.g., U.S. Pat. Nos. 5,625,126; 5,633,425; 5,569,825; 5,661,016; and 5,545,806. In addition, companies such as Abgenix, Inc. (Freemont, Calif.), can be engaged to provide human antibodies directed against a selected antigen using technology similar to that described above.

Completely human antibodies which recognize a selected epitope can be generated using a technique referred to as "guided selection." In this approach a selected non-human monoclonal antibody, e.g., a murine antibody, is used to guide the selection of a completely human antibody recognizing the same epitope (Jespers et al., 1994, *Bio/technology* 12:899-903).

The antibodies of the invention can be isolated after production (e.g., from the blood or serum of the subject) or synthesis and further purified by well-known techniques. For example, IgG antibodies can be purified using protein A chromatography. Antibodies specific for a protein of the invention can be selected or (e.g., partially purified) or purified by, e.g., affinity chromatography. For example, a recombinantly expressed and purified (or partially purified) protein of the invention is produced as described herein, and covalently or non-covalently coupled to a solid support such as, for example, a chromatography column. The column can then be used to affinity purify antibodies specific for the proteins of the invention from a sample containing antibodies directed against a large number of different epitopes, thereby generating a substantially purified antibody composition, i.e., one that is substantially free of contaminating antibodies. By a substantially purified antibody composition is meant, in this context, that the antibody sample contains at most only 30% (by dry weight) of contaminating antibodies directed against epitopes other than those of the desired protein of the invention, and preferably at most 20%, yet more preferably at most 10%, and most preferably at most 5% (by dry weight) of the sample is contaminating antibodies. A purified antibody composition means that at least 99% of the antibodies in the composition are directed against the desired protein of the invention.

In a preferred embodiment, the substantially purified antibodies of the invention may specifically bind to a signal peptide, a secreted sequence, an extracellular domain, a transmembrane or a cytoplasmic domain or cytoplasmic membrane of a protein of the invention. In a particularly preferred embodiment, the substantially purified antibodies of the invention specifically bind to a secreted sequence or an extracellular domain of the amino acid sequences of a protein of the invention. In a more preferred embodiment, the substantially purified antibodies of the invention specifically bind to a secreted sequence or an extracellular domain of the amino acid sequences of a marker protein.

An antibody directed against a protein of the invention can be used to isolate the protein by standard techniques, such as affinity chromatography or immunoprecipitation. Moreover, such an antibody can be used to detect the marker protein or fragment thereof (e.g., in a cellular lysate or cell supernatant) in order to evaluate the level and pattern of expression of the marker. The antibodies can also be used diagnostically to monitor protein levels in tissues or body fluids (e.g. in toxicity state associated body fluid) as part of a clinical testing procedure, e.g., to, for example, determine the efficacy of a given treatment regimen. Detection can be facilitated by the use of an antibody derivative, which comprises an antibody of the invention coupled to a detectable substance. Examples of detectable substances include various enzymes, prosthetic groups, fluorescent materials, luminescent materials, bioluminescent materials, and radioactive materials. Examples of suitable enzymes include horseradish peroxidase, alkaline phosphatase, β-galactosidase, or acetylcholinesterase; examples of suitable prosthetic group complexes include streptavidin/biotin and avidin/biotin; examples of suitable fluorescent materials include umbelliferone, fluorescein, fluorescein isothiocyanate, rhodamine, dichlorotriazinylamine fluorescein, dansyl chloride or phycoerythrin; an example of a luminescent material includes luminol; examples of bioluminescent materials include luciferase, luciferin, and aequorin, and examples of suitable radioactive material include $^{125}$I, $^{131}$I, $^{35}$S or $^{3}$H.

Antibodies of the invention may also be used as therapeutic agents in treating cancers. In a preferred embodiment, completely human antibodies of the invention are used for therapeutic treatment of human cancer patients, particularly those having a cancer. In another preferred embodiment, antibodies that bind specifically to a marker protein or fragment thereof are used for therapeutic treatment. Further, such therapeutic antibody may be an antibody derivative or immunotoxin comprising an antibody conjugated to a therapeutic moiety such as a cytotoxin, a therapeutic agent or a radioactive metal ion. A cytotoxin or cytotoxic agent includes any agent that is detrimental to cells. Examples include taxol, cytochalasin B, gramicidin D, ethidium bromide, emetine, mitomycin, etoposide, tenoposide, vincristine, vinblastine, colchicin, doxorubicin, daunorubicin, dihydroxy anthracin dione, mitoxantrone, mithramycin, actinomycin D, 1-dehydrotestosterone, glucocorticoids, procaine, tetracaine, lidocaine, propranolol, and puromycin and analogs or homologs thereof. Therapeutic agents include, but are not limited to, antimetabolites (e.g., methotrexate, 6-mercaptopurine, 6-thioguanine, cytarabine, 5-fluorouracil decarbazine), alkylating agents (e.g., mechlorethamine, thioepa chlorambucil, melphalan, carmustine (BSNU) and lomustine (CCNU), cyclothosphamide, busulfan, dibromomannitol, streptozotocin, mitomycin C, and cis-dichlorodiamine platinum (II) (DDP) cisplatin), anthracyclines (e.g., daunorubicin (formerly daunomycin) and doxorubicin), antibiotics (e.g., dactinomycin (formerly actinomycin), bleomycin, mithramycin, and anthramycin (AMC)), and anti-mitotic agents (e.g., vincristine and vinblastine).

The conjugated antibodies of the invention can be used for modifying a given biological response, for the drug moiety is not to be construed as limited to classical chemical therapeutic agents. For example, the drug moiety may be a protein or polypeptide possessing a desired biological activity. Such proteins may include, for example, a toxin such as ribosome-inhibiting protein (see Better et al., U.S. Pat. No. 6,146,631, the disclosure of which is incorporated herein in its entirety), abrin, ricin A, pseudomonas exotoxin, or diphtheria toxin; a protein such as tumor necrosis factor, .alpha.-interferon, β-interferon, nerve growth factor, platelet derived growth factor, tissue plasminogen activator, or, biological response modifiers such as, for example, lymphokines, interleukin-1 ("IL-1"), interleukin-2 ("IL-2"), interleukin-6 ("IL-6"), granulocyte macrophase colony stimulating factor ("GM-CSF"), granulocyte colony stimulating factor ("G-CSF"), or other growth factors.

Techniques for conjugating such therapeutic moiety to antibodies are well known, see, e.g., Amon et al., "Monoclonal Antibodies For Immunotargeting Of Drugs In Cancer Therapy", in Monoclonal Antibodies And Cancer Therapy, Reisfeld et al. (eds.), pp. 243-56 (Alan R. Liss, Inc. 1985); Hellstrom et al., "Antibodies For Drug Delivery", in Controlled Drug Delivery (2nd Ed.), Robinson et al. (eds.), pp. 623-53 (Marcel Dekker, Inc. 1987); Thorpe, "Antibody Carriers Of Cytotoxic Agents In Cancer Therapy: A Review", in Monoclonal Antibodies '84: Biological And Clinical Applications, Pinchera et al. (eds.), pp. 475-506 (1985); "Analysis, Results, And Future Prospective Of The Therapeutic Use Of Radiolabeled Antibody In Cancer Therapy", in Monoclonal Antibodies For Cancer Detection And Therapy, Baldwin et al. (eds.), pp. 303-16 (Academic Press 1985), and Thorpe et al., "The Preparation And Cytotoxic Properties Of Antibody-Toxin Conjugates", Immunol. Rev., 62:119-58 (1982).

Accordingly, in one aspect, the invention provides substantially purified antibodies, antibody fragments and derivatives, all of which specifically bind to a protein of the invention and preferably, a marker protein. In various embodiments, the substantially purified antibodies of the invention, or fragments or derivatives thereof, can be human, non-human, chimeric and/or humanized antibodies. In another aspect, the invention provides non-human antibodies, antibody fragments and derivatives, all of which specifically bind to a protein of the invention and preferably, a marker protein. Such non-human antibodies can be goat, mouse, sheep, horse, chicken, rabbit, or rat antibodies.

Alternatively, the non-human antibodies of the invention can be chimeric and/or humanized antibodies. In addition, the non-human antibodies of the invention can be polyclonal antibodies or monoclonal antibodies. In still a further aspect, the invention provides monoclonal antibodies, antibody fragments and derivatives, all of which specifically bind to a protein of the invention and preferably, a marker protein. The monoclonal antibodies can be human, humanized, chimeric and/or non-human antibodies.

The invention also provides a kit containing an antibody of the invention conjugated to a detectable substance, and instructions for use. Still another aspect of the invention is a pharmaceutical composition comprising an antibody of the invention. In one embodiment, the pharmaceutical composition comprises an antibody of the invention and a pharmaceutically acceptable carrier.

D. Predictive Medicine

The present invention pertains to the field of predictive medicine in which diagnostic assays, prognostic assays, pharmacogenomics, and monitoring clinical trails are used for prognostic (predictive) purposes to thereby treat an individual prophylactically. Accordingly, one aspect of the present invention relates to diagnostic assays for determining the level of expression of one or more marker proteins or nucleic acids, in order to determine whether an individual is at risk of developing drug-induced toxicity. Such assays can be used for prognostic or predictive purposes to thereby prophylactically treat an individual prior to the onset of the disorder.

Yet another aspect of the invention pertains to monitoring the influence of agents (e.g., drugs or other compounds administered either to inhibit or to treat or prevent or drug-induced toxicity (i.e. in order to understand any drug-induced toxic effects that such treatment may have)) on the expression or activity of a marker of the invention in clinical trials. These and other agents are described in further detail in the following sections.

E. Diagnostic Assays

An exemplary method for detecting the presence or absence of a marker protein or nucleic acid in a biological sample involves obtaining a biological sample (e.g. toxicity-associated body fluid or tissue sample) from a test subject and contacting the biological sample with a compound or an agent capable of detecting the polypeptide or nucleic acid (e.g., mRNA, genomic DNA, or cDNA). The detection methods of the invention can thus be used to detect mRNA, protein, cDNA, or genomic DNA, for example, in a biological sample in vitro as well as in vivo. For example, in vitro techniques for detection of mRNA include Northern hybridizations and in situ hybridizations. In vitro techniques for detection of a marker protein include enzyme linked immunosorbent assays (ELISAs), Western blots, immunoprecipitations and immunofluorescence. In vitro techniques for detection of genomic DNA include Southern hybridizations. In vivo techniques for detection of mRNA include polymerase chain reaction (PCR), Northern hybridizations and in situ hybridizations. Furthermore, in vivo techniques for detection of a marker protein include introducing into a subject a labeled antibody directed against the protein or fragment thereof. For example, the antibody can be labeled with a radioactive marker whose presence and location in a subject can be detected by standard imaging techniques.

A general principle of such diagnostic and prognostic assays involves preparing a sample or reaction mixture that may contain a marker, and a probe, under appropriate conditions and for a time sufficient to allow the marker and probe to interact and bind, thus forming a complex that can be removed and/or detected in the reaction mixture. These assays can be conducted in a variety of ways.

For example, one method to conduct such an assay would involve anchoring the marker or probe onto a solid phase support, also referred to as a substrate, and detecting target marker/probe complexes anchored on the solid phase at the end of the reaction. In one embodiment of such a method, a sample from a subject, which is to be assayed for presence and/or concentration of marker, can be anchored onto a carrier or solid phase support. In another embodiment, the reverse situation is possible, in which the probe can be anchored to a solid phase and a sample from a subject can be allowed to react as an unanchored component of the assay.

There are many established methods for anchoring assay components to a solid phase. These include, without limitation, marker or probe molecules which are immobilized through conjugation of biotin and streptavidin. Such biotinylated assay components can be prepared from biotin-NHS (N-hydroxy-succinimide) using techniques known in the art (e.g., biotinylation kit, Pierce Chemicals, Rockford, Ill.), and immobilized in the wells of streptavidin-coated 96 well plates (Pierce Chemical). In certain embodiments, the surfaces with immobilized assay components can be prepared in advance and stored.

Other suitable carriers or solid phase supports for such assays include any material capable of binding the class of molecule to which the marker or probe belongs. Well-known supports or carriers include, but are not limited to, glass, polystyrene, nylon, polypropylene, nylon, polyethylene, dextran, amylases, natural and modified celluloses, polyacrylamides, gabbros, and magnetite.

In order to conduct assays with the above mentioned approaches, the non-immobilized component is added to the solid phase upon which the second component is anchored. After the reaction is complete, uncomplexed components may be removed (e.g., by washing) under conditions such that any complexes formed will remain immobilized upon the solid phase. The detection of marker/probe complexes anchored to the solid phase can be accomplished in a number of methods outlined herein.

In a preferred embodiment, the probe, when it is the unanchored assay component, can be labeled for the purpose of detection and readout of the assay, either directly or indirectly, with detectable labels discussed herein and which are well-known to one skilled in the art.

It is also possible to directly detect marker/probe complex formation without further manipulation or labeling of either component (marker or probe), for example by utilizing the technique of fluorescence energy transfer (see, for example, Lakowicz et al., U.S. Pat. No. 5,631,169; Stavrianopoulos, et al., U.S. Pat. No. 4,868,103). A fluorophore label on the first, 'donor' molecule is selected such that, upon excitation with incident light of appropriate wavelength, its emitted fluorescent energy will be absorbed by a fluorescent label on a second 'acceptor' molecule, which in turn is able to fluoresce due to the absorbed energy. Alternately, the 'donor' protein molecule may simply utilize the natural fluorescent energy of tryptophan residues. Labels are chosen that emit different wavelengths of light, such that the 'acceptor' molecule label may be differentiated from that of the 'donor'. Since the efficiency of energy transfer between the labels is related to the distance separating the molecules, spatial relationships between the molecules can be assessed. In a situation in which binding occurs between the molecules, the fluorescent emission of the 'acceptor' molecule label in the assay should be maximal. An FET binding event can be conveniently measured through standard fluorometric detection means well known in the art (e.g., using a fluorimeter).

In another embodiment, determination of the ability of a probe to recognize a marker can be accomplished without labeling either assay component (probe or marker) by utilizing a technology such as real-time Biomolecular Interaction Analysis (BIA) (see, e.g., Sjolander, S. and Urbaniczky, C., 1991, *Anal. Chem.* 63:2338-2345 and Szabo et al., 1995, *Curr. Opin. Struct. Biol.* 5:699-705). As used herein, "BIA" or "surface plasmon resonance" is a technology for studying biospecific interactions in real time, without labeling any of the interactants (e.g., BIAcore). Changes in the mass at the binding surface (indicative of a binding event) result in alterations of the refractive index of light near the surface (the optical phenomenon of surface plasmon resonance (SPR)), resulting in a detectable signal which can be used as an indication of real-time reactions between biological molecules.

Alternatively, in another embodiment, analogous diagnostic and prognostic assays can be conducted with marker and probe as solutes in a liquid phase. In such an assay, the complexed marker and probe are separated from uncomplexed components by any of a number of standard techniques, including but not limited to: differential centrifugation, chromatography, electrophoresis and immunoprecipitation. In differential centrifugation, marker/probe complexes may be separated from uncomplexed assay components through a series of centrifugal steps, due to the different sedimentation equilibria of complexes based on their different sizes and densities (see, for example, Rivas, G., and Minton, A. P., 1993, *Trends Biochem Sci.* 18(8):284-7). Standard chromatographic techniques may also be utilized to separate complexed molecules from uncomplexed ones. For example, gel filtration chromatography separates molecules based on size, and through the utilization of an appropriate gel filtration resin in a column format, for example, the relatively larger complex may be separated from the relatively smaller uncomplexed components. Similarly, the relatively different charge properties of the marker/probe complex as compared to the uncomplexed components may be exploited to differentiate the complex from uncomplexed components, for example through the utilization of ion-exchange chromatography resins. Such resins and chromatographic techniques are well known to one skilled in the art (see, e.g., Heegaard, N. H., 1998, *J. Mol. Recognit.* Winter 11(1-6): 141-8; Hage, D. S., and Tweed, S. A. *J Chromatogr B Biomed Sci Appl* 1997 Oct. 10; 699(1-2):499-525). Gel electrophoresis may also be employed to separate complexed assay components from unbound components (see, e.g., Ausubel et al., ed., *Current Protocols in Molecular Biology*, John Wiley & Sons, New York, 1987-1999). In this technique, protein or nucleic acid complexes are separated based on size or charge, for example. In order to maintain the binding interaction during the electrophoretic process, non-denaturing gel matrix materials and conditions in the absence of reducing agent are typically preferred. Appropriate conditions to the particular assay and components thereof will be well known to one skilled in the art.

In a particular embodiment, the level of marker mRNA can be determined both by in situ and by in vitro formats in a biological sample using methods known in the art. The term "biological sample" is intended to include tissues, cells, biological fluids and isolates thereof, isolated from a subject, as well as tissues, cells and fluids present within a subject. Many expression detection methods use isolated RNA. For in vitro methods, any RNA isolation technique that does not select against the isolation of mRNA can be utilized for the purification of RNA from cells (see, e.g., Ausubel et al., ed., *Current Protocols in Molecular Biology*, John Wiley & Sons, New York 1987-1999). Additionally, large numbers of tissue samples can readily be processed using techniques well known to those of skill in the art, such as, for example, the single-step RNA isolation process of Chomczynski (1989, U.S. Pat. No. 4,843,155).

The isolated mRNA can be used in hybridization or amplification assays that include, but are not limited to, Southern or Northern analyses, polymerase chain reaction analyses and probe arrays. One preferred diagnostic method for the detection of mRNA levels involves contacting the isolated mRNA with a nucleic acid molecule (probe) that can hybridize to the mRNA encoded by the gene being detected. The nucleic acid probe can be, for example, a full-length cDNA, or a portion thereof, such as an oligonucleotide of at least 7, 15, 30, 50, 100, 250 or 500 nucleotides in length and sufficient to specifically hybridize under stringent conditions to a mRNA or genomic DNA encoding a marker of the present invention. Other suitable probes for use in the diagnostic assays of the invention are described herein. Hybridization of an mRNA with the probe indicates that the marker in question is being expressed.

In one format, the mRNA is immobilized on a solid surface and contacted with a probe, for example by running the isolated mRNA on an agarose gel and transferring the mRNA from the gel to a membrane, such as nitrocellulose. In an alternative format, the probe(s) are immobilized on a solid surface and the mRNA is contacted with the probe(s), for example, in an Affymetrix gene chip array. A skilled artisan can readily adapt known mRNA detection methods for use in detecting the level of mRNA encoded by the markers of the present invention.

An alternative method for determining the level of mRNA marker in a sample involves the process of nucleic acid amplification, e.g., by RT-PCR (the experimental embodiment set forth in Mullis, 1987, U.S. Pat. No. 4,683,202), ligase chain reaction (Barany, 1991, *Proc. Natl. Acad. Sci. USA*, 88:189-193), self sustained sequence replication (Guatelli et al., 1990, *Proc. Natl. Acad. Sci. USA* 87:1874-1878), transcriptional amplification system (Kwoh et al., 1989, *Proc. Natl. Acad. Sci. USA* 86:1173-1177), Q-Beta Replicase (Lizardi et al., 1988, *Bio/Technology* 6:1197), rolling circle replication (Lizardi et al., U.S. Pat. No. 5,854,033) or any other nucleic acid amplification method, followed by the detection of the amplified molecules using techniques well known to those of skill in the art. These detection schemes are especially useful for the detection of nucleic acid molecules if such molecules are present in very low numbers. As used herein, amplification primers are defined as being a pair of nucleic acid molecules that can anneal to 5' or 3' regions of a gene (plus and minus strands, respectively, or vice-versa) and contain a short region in between. In general, amplification primers are from about 10 to 30 nucleotides in length and flank a region from about 50 to 200 nucleotides in length. Under appropriate conditions and with appropriate reagents, such primers permit the amplification of a nucleic acid molecule comprising the nucleotide sequence flanked by the primers.

For in situ methods, mRNA does not need to be isolated from the prior to detection. In such methods, a cell or tissue sample is prepared/processed using known histological methods. The sample is then immobilized on a support, typically a glass slide, and then contacted with a probe that can hybridize to mRNA that encodes the marker.

As an alternative to making determinations based on the absolute expression level of the marker, determinations may be based on the normalized expression level of the marker. Expression levels are normalized by correcting the absolute expression level of a marker by comparing its expression to the expression of a gene that is not a marker, e.g., a housekeeping gene that is constitutively expressed. Suitable genes for normalization include housekeeping genes such as the actin gene, or epithelial cell-specific genes. This normalization allows the comparison of the expression level in one sample, e.g., a patient sample, to another sample, e.g., a non-disease or non-toxic sample, or between samples from different sources.

Alternatively, the expression level can be provided as a relative expression level. To determine a relative expression level of a marker, the level of expression of the marker is determined for 10 or more samples of normal versus disease or toxic cell isolates, preferably 50 or more samples, prior to the determination of the expression level for the sample in question. The mean expression level of each of the genes assayed in the larger number of samples is determined and this is used as a baseline expression level for the marker. The expression level of the marker determined for the test sample (absolute level of expression) is then divided by the mean expression value obtained for that marker. This provides a relative expression level.

Preferably, the samples used in the baseline determination will be from non-toxic cells. The choice of the cell source is dependent on the use of the relative expression level. Using expression found in normal tissues as a mean expression score aids in validating whether the marker assayed is toxicity specific (versus normal cells). In addition, as more data is accumulated, the mean expression value can be revised, providing improved relative expression values based on accumulated data. Expression data from disease cells or toxic cells provides a means for grading the severity of the disease or toxic state.

In another embodiment of the present invention, a marker protein is detected. A preferred agent for detecting marker protein of the invention is an antibody capable of binding to such a protein or a fragment thereof, preferably an antibody with a detectable label. Antibodies can be polyclonal, or more preferably, monoclonal. An intact antibody, or a fragment or derivative thereof (e.g., Fab or F(ab')$_2$) can be used. The term "labeled", with regard to the probe or antibody, is intended to encompass direct labeling of the probe or antibody by coupling (i.e., physically linking) a detectable substance to the probe or antibody, as well as indirect labeling of the probe or antibody by reactivity with another reagent that is directly labeled. Examples of indirect labeling include detection of a primary antibody using a fluorescently labeled secondary antibody and end-labeling of a DNA probe with biotin such that it can be detected with fluorescently labeled streptavidin.

Proteins from cells can be isolated using techniques that are well known to those of skill in the art. The protein isolation methods employed can, for example, be such as those described in Harlow and Lane (Harlow and Lane, 1988, *Antibodies: A Laboratory Manual*, Cold Spring Harbor Laboratory Press, Cold Spring Harbor, New York).

A variety of formats can be employed to determine whether a sample contains a protein that binds to a given antibody. Examples of such formats include, but are not limited to, enzyme immunoassay (EIA), radioimmunoassay (RIA), Western blot analysis and enzyme linked immunoabsorbent assay (ELISA). A skilled artisan can readily adapt known protein/antibody detection methods for use in determining whether cells express a marker of the present invention.

In one format, antibodies, or antibody fragments or derivatives, can be used in methods such as Western blots or immunofluorescence techniques to detect the expressed proteins. In such uses, it is generally preferable to immobilize either the antibody or proteins on a solid support. Suitable solid phase supports or carriers include any support capable of binding an antigen or an antibody. Well-known supports or carriers include glass, polystyrene, polypropylene, polyethylene, dextran, nylon, amylases, natural and modified celluloses, polyacrylamides, gabbros, and magnetite.

One skilled in the art will know many other suitable carriers for binding antibody or antigen, and will be able to adapt such support for use with the present invention. For example, protein isolated from disease or toxic cells can be run on a polyacrylamide gel electrophoresis and immobilized onto a solid phase support such as nitrocellulose. The support can then be washed with suitable buffers followed by treatment with the detectably labeled antibody. The solid phase support can then be washed with the buffer a second time to remove unbound antibody. The amount of bound label on the solid support can then be detected by conventional means.

The invention also encompasses kits for detecting the presence of a marker protein or nucleic acid in a biological sample. Such kits can be used to determine if a subject is suffering from or is at increased risk of developing drug-induced toxicity. For example, the kit can comprise a labeled compound or agent capable of detecting a marker protein or nucleic acid in a biological sample and means for determining the amount of the protein or mRNA in the sample (e.g., an antibody which binds the protein or a fragment thereof, or an oligonucleotide probe which binds to DNA or mRNA encoding the protein). Kits can also include instructions for interpreting the results obtained using the kit.

For antibody-based kits, the kit can comprise, for example: (1) a first antibody (e.g., attached to a solid support) which binds to a marker protein; and, optionally, (2) a second, different antibody which binds to either the protein or the first antibody and is conjugated to a detectable label.

For oligonucleotide-based kits, the kit can comprise, for example: (1) an oligonucleotide, e.g., a detectably labeled oligonucleotide, which hybridizes to a nucleic acid sequence encoding a marker protein or (2) a pair of primers useful for amplifying a marker nucleic acid molecule. The kit can also comprise, e.g., a buffering agent, a preservative, or a protein stabilizing agent. The kit can further comprise components necessary for detecting the detectable label (e.g., an enzyme or a substrate). The kit can also contain a control sample or a series of control samples which can be assayed and compared to the test sample. Each component of the kit can be enclosed within an individual container and all of the various containers can be within a single package, along with instructions for interpreting the results of the assays performed using the kit.

F. Pharmacogenomics

The markers of the invention are also useful as pharmacogenomic markers. As used herein, a "pharmacogenomic marker" is an objective biochemical marker whose expression level correlates with a specific clinical drug response or susceptibility in a patient (see, e.g., McLeod et al. (1999) *Eur. J. Cancer* 35(12): 1650-1652). The presence or quantity of the pharmacogenomic marker expression is related to the predicted response of the patient and more particularly the patient's diseased or toxic cells to therapy with a specific drug or class of drugs. By assessing the presence or quantity of the expression of one or more pharmacogenomic markers in a patient, a drug therapy which is most appropriate for the patient, or which is predicted to have a greater degree of success, may be selected. For example, based on the presence or quantity of RNA or protein encoded by specific tumor markers in a patient, a drug or course of treatment may be selected that is optimized for the treatment of the specific tumor likely to be present in the patient. The use of pharmacogenomic markers therefore permits selecting or designing the most appropriate treatment for each cancer patient without trying different drugs or regimes.

Another aspect of pharmacogenomics deals with genetic conditions that alters the way the body acts on drugs. These pharmacogenetic conditions can occur either as rare defects or as polymorphisms. For example, glucose-6-phosphate dehydrogenase (G6PD) deficiency is a common inherited enzymopathy in which the main clinical complication is hemolysis after ingestion of oxidant drugs (anti-malarials, sulfonamides, analgesics, nitrofurans) and consumption of fava beans.

As an illustrative embodiment, the activity of drug metabolizing enzymes is a major determinant of both the intensity and duration of drug action. The discovery of genetic polymorphisms of drug metabolizing enzymes (e.g., N-acetyltransferase 2 (NAT 2) and cytochrome P450 enzymes CYP2D6 and CYP2C, 19) has provided an explanation as to why some patients do not obtain the expected drug effects or show exaggerated drug response and serious toxicity after taking the standard and safe dose of a drug. These polymorphisms are expressed in two phenotypes in the population, the extensive metabolizer (EM) and poor metabolizer (PM). The prevalence of PM is different among different populations. For example, the gene coding for CYP2D6 is highly polymorphic and several mutations have been identified in PM, which all lead to the absence of functional CYP2D6. Poor metabolizers of CYP2D6 and CYP2C, 19 quite frequently experience exaggerated drug response and side effects when they receive standard doses. If a metabolite is the active therapeutic moiety, a PM will show no therapeutic response, as demonstrated for the analgesic effect of codeine mediated by its CYP2D6-formed metabolite morphine. The other extreme are the so called ultra-rapid metabolizers who do not respond to standard doses. Recently, the molecular basis of ultra-rapid metabolism has been identified to be due to CYP2D6 gene amplification.

Thus, the level of expression of a marker of the invention in an individual can be determined to thereby select appropriate agent(s) for therapeutic or prophylactic treatment of the individual. In addition, pharmacogenetic studies can be used to apply genotyping of polymorphic alleles encoding drug-metabolizing enzymes to the identification of an individual's drug responsiveness phenotype. This knowledge, when applied to dosing or drug selection, can avoid adverse reactions or therapeutic failure and thus enhance therapeutic or prophylactic efficiency when treating a subject with a modulator of expression of a marker of the invention.

G. Monitoring Clinical Trials

Monitoring the influence of agents (e.g., drug compounds) on the level of expression of a marker of the invention can be applied not only in basic drug screening, but also in clinical trials. For example, the effectiveness of an agent to affect marker expression can be monitored in clinical trials of subjects receiving treatment for cardiotoxicity, or drug-induced toxicity. In a preferred embodiment, the present invention provides a method for monitoring the effectiveness of treatment of a subject with an agent (e.g., an agonist, antagonist, peptidomimetic, protein, peptide, nucleic acid, small molecule, or other drug candidate) comprising the steps of (i) obtaining a pre-administration sample from a subject prior to administration of the agent; (ii) detecting the level of expression of one or more selected markers of the invention in the pre-administration sample; (iii) obtaining one or more post-administration samples from the subject; (iv) detecting the level of expression of the marker(s) in the post-administration samples; (v) comparing the level of expression of the marker(s) in the pre-administration sample with the level of expression of the marker(s) in the post-administration sample or samples; and (vi) altering the administration of the agent to the subject accordingly. For example, increased expression of the marker gene(s) during the course of treatment may indicate ineffective dosage and the desirability of increasing the dosage. Conversely, decreased expression of the marker gene(s) may indicate efficacious treatment and no need to change dosage.

H. Arrays

The invention also includes an array comprising a marker of the present invention. The array can be used to assay expression of one or more genes in the array. In one embodiment, the array can be used to assay gene expression in a tissue to ascertain tissue specificity of genes in the array. In this manner, up to about 7600 genes can be simultaneously assayed for expression. This allows a profile to be developed showing a battery of genes specifically expressed in one or more tissues.

In addition to such qualitative determination, the invention allows the quantitation of gene expression. Thus, not only tissue specificity, but also the level of expression of a battery of genes in the tissue is ascertainable. Thus, genes can be grouped on the basis of their tissue expression per se and level of expression in that tissue. This is useful, for example, in ascertaining the relationship of gene expression between or among tissues. Thus, one tissue can be perturbed and the effect on gene expression in a second tissue can be determined. In this context, the effect of one cell type on another cell type in response to a biological stimulus can be determined. Such a determination is useful, for example, to know the effect of cell-cell interaction at the level of gene expression. If an agent is administered therapeutically to treat one cell type but has an undesirable effect on another cell type, the invention provides an assay to determine the molecular basis of the undesirable effect and thus provides the opportunity to co-administer a counteracting agent or otherwise treat the undesired effect. Similarly, even within a single cell type, undesirable biological effects can be determined at the molecular level. Thus, the effects of an agent on expression of other than the target gene can be ascertained and counteracted.

In another embodiment, the array can be used to monitor the time course of expression of one or more genes in the array. This can occur in various biological contexts, as disclosed herein, for example development of drug-induced toxicity, progression of drug-induced toxicity, and processes, such a cellular transformation associated with drug-induced toxicity.

The array is also useful for ascertaining the effect of the expression of a gene on the expression of other genes in the same cell or in different cells. This provides, for example, for a selection of alternate molecular targets for therapeutic intervention if the ultimate or downstream target cannot be regulated.

The array is also useful for ascertaining differential expression patterns of one or more genes in normal and abnormal cells. This provides a battery of genes that could serve as a molecular target for diagnosis or therapeutic intervention.

VII. Methods for Obtaining Samples

Samples useful in the methods of the invention include any tissue, cell, biopsy, or bodily fluid sample that expresses a marker of the invention. In one embodiment, a sample may be a tissue, a cell, whole blood, serum, plasma, buccal scrape, saliva, cerebrospinal fluid, urine, stool, or bronchioalveolar lavage. In preferred embodiments, the tissue sample is a toxicity state sample. In more preferred embodiments, the tissue sample is a cardiovascular sample or a drug-induced toxicity sample.

Body samples may be obtained from a subject by a variety of techniques known in the art including, for example, by the use of a biopsy or by scraping or swabbing an area or by using a needle to aspirate bodily fluids. Methods for collecting various body samples are well known in the art.

Tissue samples suitable for detecting and quantitating a marker of the invention may be fresh, frozen, or fixed according to methods known to one of skill in the art. Suitable tissue samples are preferably sectioned and placed on a microscope slide for further analyses. Alternatively, solid samples, i.e., tissue samples, may be solubilized and/or homogenized and subsequently analyzed as soluble extracts.

In one embodiment, a freshly obtained biopsy sample is frozen using, for example, liquid nitrogen or difluorodichloromethane. The frozen sample is mounted for sectioning using, for example, OCT, and serially sectioned in a cryostat. The serial sections are collected on a glass microscope slide. For immunohistochemical staining the slides may be coated with, for example, chrome-alum, gelatine or poly-L-lysine to ensure that the sections stick to the slides. In another embodiment, samples are fixed and embedded prior to sectioning. For example, a tissue sample may be fixed in, for example, formalin, serially dehydrated and embedded in, for example, paraffin.

Once the sample is obtained any method known in the art to be suitable for detecting and quantitating a marker of the invention may be used (either at the nucleic acid or at the protein level). Such methods are well known in the art and include but are not limited to western blots, northern blots, southern blots, immunohistochemistry, ELISA, e.g., amplified ELISA, immunoprecipitation, immunofluorescence, flow cytometry, immunocytochemistry, mass spectrometrometric analyses, e.g., MALDI-TOF and SELDI-TOF, nucleic acid hybridization techniques, nucleic acid reverse transcription methods, and nucleic acid amplification methods. In particular embodiments, the expression of a marker of the invention is detected on a protein level using, for example, antibodies that specifically bind these proteins.

Samples may need to be modified in order to make a marker of the invention accessible to antibody binding. In a particular aspect of the immunocytochemistry or immunohistochemistry methods, slides may be transferred to a pretreatment buffer and optionally heated to increase antigen accessibility. Heating of the sample in the pretreatment buffer rapidly disrupts the lipid bi-layer of the cells and makes the antigens (may be the case in fresh specimens, but not typically what occurs in fixed specimens) more accessible for antibody binding. The terms "pretreatment buffer" and "preparation buffer" are used interchangeably herein to refer to a buffer that is used to prepare cytology or histology samples for immunostaining, particularly by increasing the accessibility of a marker of the invention for antibody binding. The pretreatment buffer may comprise a pH-specific salt solution, a polymer, a detergent, or a nonionic or anionic surfactant such as, for example, an ethyloxylated anionic or nonionic surfactant, an alkanoate or an alkoxylate or even blends of these surfactants or even the use of a bile salt. The pretreatment buffer may, for example, be a solution of 0.1% to 1% of deoxycholic acid, sodium salt, or a solution of sodium laureth-13-carboxylate (e.g., Sandopan LS) or and ethoxylated anionic complex. In some embodiments, the pretreatment buffer may also be used as a slide storage buffer.

Any method for making marker proteins of the invention more accessible for antibody binding may be used in the practice of the invention, including the antigen retrieval methods known in the art. See, for example, Bibbo, et al. (2002) *Acta. Cytol.* 46:25-29; Saqi, et al. (2003) *Diagn. Cytopathol.* 27:365-370; Bibbo, et al. (2003) *Anal. Quant. Cytol. Histol.* 25:8-11, the entire contents of each of which are incorporated herein by reference.

Following pretreatment to increase marker protein accessibility, samples may be blocked using an appropriate blocking agent, e.g., a peroxidase blocking reagent such as hydrogen peroxide. In some embodiments, the samples may be blocked using a protein blocking reagent to prevent non-specific binding of the antibody. The protein blocking reagent may comprise, for example, purified casein. An antibody, particularly a monoclonal or polyclonal antibody that specifically binds to a marker of the invention is then incubated with the sample. One of skill in the art will appreciate that a more accurate prognosis or diagnosis may be obtained in some cases by detecting multiple epitopes on a marker protein of the invention in a patient sample. Therefore, in particular embodiments, at least two antibodies directed to different epitopes of a marker of the invention are used. Where more than one antibody is used, these antibodies may be added to a single sample sequentially as individual antibody reagents or simultaneously as an antibody cocktail. Alternatively, each individual antibody may be added to a separate sample from the same patient, and the resulting data pooled.

Techniques for detecting antibody binding are well known in the art. Antibody binding to a marker of the invention may be detected through the use of chemical reagents that generate a detectable signal that corresponds to the level of antibody binding and, accordingly, to the level of marker protein expression. In one of the immunohistochemistry or immunocytochemistry methods of the invention, antibody binding is detected through the use of a secondary antibody that is conjugated to a labeled polymer. Examples of labeled polymers include but are not limited to polymer-enzyme conjugates. The enzymes in these complexes are typically used to catalyze the deposition of a chromogen at the antigen-antibody binding site, thereby resulting in cell staining that corresponds to expression level of the biomarker of interest. Enzymes of particular interest include, but are not limited to, horseradish peroxidase (HRP) and alkaline phosphatase (AP).

In one particular immunohistochemistry or immunocytochemistry method of the invention, antibody binding to a marker of the invention is detected through the use of an HRP-labeled polymer that is conjugated to a secondary antibody. Antibody binding can also be detected through the use of a species-specific probe reagent, which binds to monoclonal or polyclonal antibodies, and a polymer conjugated to HRP, which binds to the species specific probe reagent. Slides are stained for antibody binding using any chromogen, e.g., the chromogen 3,3-diaminobenzidine (DAB), and then counterstained with hematoxylin and, optionally, a bluing agent such as ammonium hydroxide or TBS/Tween-20. Other suitable chromagens include, for example, 3-amino-9-ethylcarbazole (AEC). In some aspects of the invention, slides are reviewed microscopically by a cytotechnologist and/or a pathologist to assess cell staining, e.g., fluorescent staining (i.e., marker expression). Alternatively, samples may be reviewed via automated microscopy or by personnel with the assistance of computer software that facilitates the identification of positive staining cells.

Detection of antibody binding can be facilitated by coupling the anti-marker antibodies to a detectable substance. Examples of detectable substances include various enzymes, prosthetic groups, fluorescent materials, luminescent materials, bioluminescent materials, and radioactive materials. Examples of suitable enzymes include horseradish peroxidase, alkaline phosphatase, j-galactosidase, or acetylcholinesterase; examples of suitable prosthetic group complexes include streptavidin/biotin and avidin/biotin; examples of suitable fluorescent materials include umbelliferone, fluorescein, fluorescein isothiocyanate, rhodamine, dichlorotriazinylamine fluorescein, dansyl chloride or phycoerythrin; an example of a luminescent material includes luminol; examples of bioluminescent materials include luciferase, luciferin, and aequorin; and examples of suitable radioactive material include $^{125}I$, $^{131}I$ $^{35}S$, $^{14}C$, or $^3H$.

In one embodiment of the invention frozen samples are prepared as described above and subsequently stained with antibodies against a marker of the invention diluted to an appropriate concentration using, for example, Tris-buffered saline (TBS). Primary antibodies can be detected by incubating the slides in biotinylated anti-immunoglobulin. This signal can optionally be amplified and visualized using diaminobenzidine precipitation of the antigen. Furthermore, slides can be optionally counterstained with, for example, hematoxylin, to visualize the cells.

In another embodiment, fixed and embedded samples are stained with antibodies against a marker of the invention and counterstained as described above for frozen sections. In addition, samples may be optionally treated with agents to amplify the signal in order to visualize antibody staining. For example, a peroxidase-catalyzed deposition of biotinyltyramide, which in turn is reacted with peroxidase-conjugated streptavidin (Catalyzed Signal Amplification (CSA) System, DAKO, Carpinteria, Calif.) may be used.

Tissue-based assays (i.e., immunohistochemistry) are the preferred methods of detecting and quantitating a marker of the invention. In one embodiment, the presence or absence of a marker of the invention may be determined by immunohistochemistry. In one embodiment, the immunohistochemical analysis uses low concentrations of an anti-marker antibody such that cells lacking the marker do not stain. In another embodiment, the presence or absence of a marker of the invention is determined using an immunohistochemical method that uses high concentrations of an anti-marker antibody such that cells lacking the marker protein stain heavily. Cells that do not stain contain either mutated marker and fail to produce antigenically recognizable marker protein, or are cells in which the pathways that regulate marker levels are dysregulated, resulting in steady state expression of negligible marker protein.

One of skill in the art will recognize that the concentration of a particular antibody used to practice the methods of the invention will vary depending on such factors as time for binding, level of specificity of the antibody for a marker of the invention, and method of sample preparation. Moreover, when multiple antibodies are used, the required concentration may be affected by the order in which the antibodies are applied to the sample, e.g., simultaneously as a cocktail or sequentially as individual antibody reagents. Furthermore, the detection chemistry used to visualize antibody binding to a marker of the invention must also be optimized to produce the desired signal to noise ratio.

In one embodiment of the invention, proteomic methods, e.g., mass spectrometry, are used for detecting and quantitating the marker proteins of the invention. For example, matrix-associated laser desorption/ionization time-of-flight mass spectrometry (MALDI-TOF MS) or surface-enhanced laser desorption/ionization time-of-flight mass spectrometry (SELDI-TOF MS) which involves the application of a biological sample, such as serum, to a protein-binding chip (Wright, G. L., Jr., et al. (2002) Expert Rev Mol Diagn 2:549; Li, J., et al. (2002) Clin Chem 48:1296; Laronga, C., et al. (2003) Dis Markers 19:229; Petricoin, E. F., et al. (2002) 359:572; Adam, B. L., et al. (2002) Cancer Res 62:3609; Tolson, J., et al. (2004) Lab Invest 84:845; Xiao, Z., et al. (2001) Cancer Res 61:6029) can be used to detect and quantitate the PY-Shc and/or p66-Shc proteins. Mass spectrometric methods are described in, for example, U.S. Pat. Nos. 5,622,824, 5,605,798 and 5,547,835, the entire contents of each of which are incorporated herein by reference.

In other embodiments, the expression of a marker of the invention is detected at the nucleic acid level. Nucleic acid-based techniques for assessing expression are well known in the art and include, for example, determining the level of marker mRNA in a sample from a subject.

Many expression detection methods use isolated RNA. Any RNA isolation technique that does not select against the isolation of mRNA can be utilized for the purification of RNA from cells that express a marker of the invention (see, e.g., Ausubel et al., ed., (1987-1999) Current Protocols in Molecular Biology (John Wiley & Sons, New York). Additionally, large numbers of tissue samples can readily be processed using techniques well known to those of skill in the art, such as, for example, the single-step RNA isolation process of Chomczynski (1989, U.S. Pat. No. 4,843,155).

The term "probe" refers to any molecule that is capable of selectively binding to a marker of the invention, for example, a nucleotide transcript and/or protein. Probes can be synthesized by one of skill in the art, or derived from appropriate biological preparations. Probes may be specifically designed to be labeled. Examples of molecules that can be utilized as probes include, but are not limited to, RNA, DNA, proteins, antibodies, and organic molecules.

Isolated mRNA can be used in hybridization or amplification assays that include, but are not limited to, Southern or Northern analyses, polymerase chain reaction analyses and probe arrays. One method for the detection of mRNA levels involves contacting the isolated mRNA with a nucleic acid molecule (probe) that can hybridize to the marker mRNA. The nucleic acid probe can be, for example, a full-length cDNA, or a portion thereof, such as an oligonucleotide of at least 7, 15, 30, 50, 100, 250 or 500 nucleotides in length and sufficient to specifically hybridize under stringent conditions to marker genomic DNA.

In one embodiment, the mRNA is immobilized on a solid surface and contacted with a probe, for example by running the isolated mRNA on an agarose gel and transferring the mRNA from the gel to a membrane, such as nitrocellulose. In an alternative embodiment, the probe(s) are immobilized on a solid surface and the mRNA is contacted with the probe(s), for example, in an Affymetrix gene chip array. A skilled artisan can readily adapt known mRNA detection methods for use in detecting the level of marker mRNA.

An alternative method for determining the level of marker mRNA in a sample involves the process of nucleic acid amplification, e.g., by RT-PCR (the experimental embodiment set forth in Mullis, 1987, U.S. Pat. No. 4,683,202), ligase chain reaction (Barany (1991) *Proc. Natl. Acad. Sci. USA* 88:189-193), self sustained sequence replication (Guatelli et al. (1990) *Proc. Natl. Acad. Sci. USA* 87:1874-1878), transcriptional amplification system (Kwoh et al. (1989) *Proc. Natl. Acad. Sci. USA* 86:1173-1177), Q-Beta Replicase (Lizardi et al. (1988) *Bio/Technology* 6:1197), rolling circle replication (Lizardi et al., U.S. Pat. No. 5,854,033) or any other nucleic acid amplification method, followed by the detection of the amplified molecules using techniques well known to those of skill in the art. These detection schemes are especially useful for the detection of nucleic acid molecules if such molecules are present in very low numbers. In particular aspects of the invention, marker expression is assessed by quantitative fluorogenic RT-PCR (i.e., the TaqMan™ System). Such methods typically utilize pairs of oligonucleotide primers that are specific for a marker of the invention. Methods for designing oligonucleotide primers specific for a known sequence are well known in the art.

The expression levels of a marker of the invention may be monitored using a membrane blot (such as used in hybridization analysis such as Northern, Southern, dot, and the like), or microwells, sample tubes, gels, beads or fibers (or any solid support comprising bound nucleic acids). See U.S. Pat. Nos. 5,770,722, 5,874,219, 5,744,305, 5,677,195 and 5,445,934, which are incorporated herein by reference. The detection of marker expression may also comprise using nucleic acid probes in solution.

In one embodiment of the invention, microarrays are used to detect the expression of a marker of the invention. Microarrays are particularly well suited for this purpose because of the reproducibility between different experiments. DNA microarrays provide one method for the simultaneous measurement of the expression levels of large numbers of genes. Each array consists of a reproducible pattern of capture probes attached to a solid support. Labeled RNA or DNA is hybridized to complementary probes on the array and then detected by laser scanning. Hybridization intensities for each probe on the array are determined and converted to a quantitative value representing relative gene expression levels. See, U.S. Pat. Nos. 6,040,138, 5,800,992 and 6,020,135, 6,033,860, and 6,344,316, which are incorporated herein by reference. High-density oligonucleotide arrays are particularly useful for determining the gene expression profile for a large number of RNA's in a sample.

The amounts of marker, and/or a mathematical relationship of the amounts of a marker of the invention may be used to calculate the risk of a toxicity state, e.g., a drug-induced toxicity or cardiotoxicity, in a subject being treated with a drug, the efficacy of a treatment regimen for treating, preventing or counteracting a toxicity state, and the like, using the methods of the invention, which may include methods of regression analysis known to one of skill in the art. For example, suitable regression models include, but are not limited to CART (e.g., Hill, T, and Lewicki, P. (2006) "STATISTICS Methods and Applications" StatSoft, Tulsa, Okla.), Cox (e.g., www.evidence-based-medicine.co.uk), exponential, normal and log normal (e.g., www.obgyn.cam.ac.uk/mrg/statsbook/stsurvan.html), logistic (e.g., www.en.wikipedia.org/wiki/Logistic_regression), parametric, non-parametric, semi-parametric (e.g., www.socserv.mcmaster.ca/jfox/Books/Companion), linear (e.g., www.en.wikipedia.org/wiki/Linear_regression), or additive (e.g., www.en.wikipedia.org/wiki/Generalized_additive_model).

In one embodiment, a regression analysis includes the amounts of marker. In another embodiment, a regression analysis includes a marker mathematical relationship. In yet another embodiment, a regression analysis of the amounts of marker, and/or a marker mathematical relationship may include additional clinical and/or molecular co-variates. Such clinical co-variates include, but are not limited to, nodal status, tumor stage, tumor grade, tumor size, treatment regime, e.g., chemotherapy and/or radiation therapy, clinical outcome (e.g., relapse, disease-specific survival, therapy failure), and/or clinical outcome as a function of time after diagnosis, time after initiation of therapy, and/or time after completion of treatment.

VIII. Kits

The invention also provides compositions and kits for identifying an agent at risk for causing drug-induced toxicity, e.g., cardiotoxicity, for prognosing a cardiotoxic state, e.g., a drug-induced cardiotoxicity, recurrence of cardiotoxicity, or survival of a subject being treated for cardiotoxicity. These kits include one or more of the following: a detectable antibody that specifically binds to a marker of the invention, a detectable antibody that specifically binds to a marker of the invention, reagents for obtaining and/or preparing subject tissue samples for staining, and instructions for use.

The kits of the invention may optionally comprise additional components useful for performing the methods of the invention. By way of example, the kits may comprise fluids (e.g., SSC buffer) suitable for annealing complementary nucleic acids or for binding an antibody with a protein with which it specifically binds, one or more sample compartments, an instructional material which describes performance of a method of the invention and tissue specific controls/standards.

IX. Screening Assays

Targets of the invention include, but are not limited to, the genes and/or proteins listed herein. Based on the results of experiments described by Applicants herein, the key proteins modulated in a toxicity state are associated with or can be classified into different pathways or groups of molecules, including cytoskeletal components, transcription factors, apoptotic response, pentose phosphate pathway, biosynthetic pathway, oxidative stress (pro-oxidant), membrane alterations, and oxidative phosphorylation metabolism. Accordingly, in one embodiment of the invention, a marker may include one or more genes (or proteins) selected from the markers listed in table 2. In some embodiments, the markers are a combination of at least two, three, four, five, six, seven, eight, nine, ten, eleven, twelve, thirteen, fourteen, fifteen, sixteen, seventeen, eighteen, nineteen, twenty, twenty-five, thirty, 40, 50, 60, 70, 80, 90, 100, 110, 120, 130, 140, 150, 160, or more of the foregoing genes (or proteins).

Screening assays useful for identifying modulators of identified markers are described below.

The invention also provides methods (also referred to herein as "screening assays") for identifying modulators, i.e., candidate or test compounds or agents (e.g., proteins, peptides, peptidomimetics, peptoids, small molecules or other drugs), which are useful for treating or preventing a toxicity state by modulating the expression and/or activity of a marker of the invention. Such assays typically comprise a reaction between a marker of the invention and one or more assay components. The other components may be either the test compound itself, or a combination of test compounds and a natural binding partner of a marker of the invention. Compounds identified via assays such as those described herein may be useful, for example, for modulating, e.g., inhibiting, ameliorating, treating, or preventing aggressiveness of a disease state or toxicity state.

The test compounds used in the screening assays of the present invention may be obtained from any available source, including systematic libraries of natural and/or synthetic compounds. Test compounds may also be obtained by any of the numerous approaches in combinatorial library methods known in the art, including: biological libraries; peptoid libraries (libraries of molecules having the functionalities of peptides, but with a novel, non-peptide backbone which are resistant to enzymatic degradation but which nevertheless remain bioactive; see, e.g., Zuckermann et al., 1994, *J. Med. Chem.* 37:2678-85); spatially addressable parallel solid phase or solution phase libraries; synthetic library methods requiring deconvolution; the 'one-bead one-compound' library method; and synthetic library methods using affinity chromatography selection. The biological library and peptoid library approaches are limited to peptide libraries, while the other four approaches are applicable to peptide, non-peptide oligomer or small molecule libraries of compounds (Lam, 1997, *Anticancer Drug Des.* 12:145).

Examples of methods for the synthesis of molecular libraries can be found in the art, for example in: DeWitt et al. (1993) *Proc. Natl. Acad. Sci. U.S.A.* 90:6909; Erb et al. (1994) *Proc. Natl. Acad. Sci. USA* 91:11422; Zuckermann et al. (1994). *J. Med. Chem.* 37:2678; Cho et al. (1993) *Science* 261:1303; Carrell et al. (1994) *Angew. Chem. Int. Ed. Engl.* 33:2059; Carell et al. (1994) *Angew. Chem. Int. Ed. Engl.* 33:2061; and in Gallop et al. (1994) *J. Med. Chem.* 37:1233.

Libraries of compounds may be presented in solution (e.g., Houghten, 1992, *Biotechniques* 13:412-421), or on beads (Lam, 1991, *Nature* 354:82-84), chips (Fodor, 1993, *Nature* 364:555-556), bacteria and/or spores, (Ladner, U.S. Pat. No. 5,223,409), plasmids (Cull et al, 1992, *Proc Natl Acad Sci USA* 89:1865-1869) or on phage (Scott and Smith, 1990, *Science* 249:386-390; Devlin, 1990, *Science* 249:404-406; Cwirla et al, 1990, *Proc. Natl. Acad. Sci.* 87:6378-6382; Felici, 1991, *J. Mol. Biol.* 222:301-310; Ladner, supra.).

The screening methods of the invention comprise contacting a toxicity state cell with a test compound and determining the ability of the test compound to modulate the expression and/or activity of a marker of the invention in the cell. The expression and/or activity of a marker of the invention can be determined as described herein.

In another embodiment, the invention provides assays for screening candidate or test compounds which are substrates of a marker of the invention or biologically active portions thereof. In yet another embodiment, the invention provides assays for screening candidate or test compounds which bind to a marker of the invention or biologically active portions thereof. Determining the ability of the test compound to directly bind to a marker can be accomplished, for example, by coupling the compound with a radioisotope or enzymatic label such that binding of the compound to the marker can be determined by detecting the labeled marker compound in a complex. For example, compounds (e.g., marker substrates) can be labeled with $^{131}I$, $^{125}I$, $^{35}S$, $^{14}C$, or $^{3}H$, either directly or indirectly, and the radioisotope detected by direct counting of radioemission or by scintillation counting. Alternatively, assay components can be enzymatically labeled with, for example, horseradish peroxidase, alkaline phosphatase, or luciferase, and the enzymatic label detected by determination of conversion of an appropriate substrate to product.

This invention further pertains to novel agents identified by the above-described screening assays. Accordingly, it is within the scope of this invention to further use an agent identified as described herein in an appropriate animal model. For example, an agent capable of modulating the expression and/or activity of a marker of the invention identified as described herein can be used in an animal model to determine the efficacy, toxicity, or side effects of treatment with such an agent. Alternatively, an agent identified as described herein can be used in an animal model to determine the mechanism of action of such an agent. Furthermore, this invention pertains to uses of novel agents identified by the above-described screening assays for treatment as described above.

EXEMPLIFICATION OF THE INVENTION

Example 1: Employing Platform Technology to Build Models of Drug Induced Cardiotoxicity In this example, the platform technology described in detail in international PCT Application No. PCT/US2012/027615 was employed to integrate data obtained from a custom built drug-induced cardiotoxicity model, and to identify novel proteins/pathways driving the pathogenesis/cardiotoxicity of drugs. Relational maps resulting from this analysis have provided drug-induced cardiotoxicity biomarkers.

In the healthy heart contractile function depends on a balance of fatty acid and carbohydrate oxidation. Chronic imbalance in uptake, utilization, organellar biogenesis and secretion in non-adipose tissue (heart and liver) is thought to be at the center of mitochondrial damage and dysfunction and a key player in drug induced cardiotoxicity. Here Applicants describe a systems approach combining protein and lipid signatures with functional end point assays specifically looking at cellular bioenergetics and mitochondrial membrane function. In vitro models comprising diabetic and normal cardiomyocytes supplemented with excessive fatty acid and hyperglycemia were treated with a panel of drugs to create signatures and potential mechanisms of toxicity. Applicants demonstrated the varied effects of drugs in destabilizing the mitochondria by disrupting the energy metabolism component at various levels including (i) Dysregulation of transcriptional networks that controls expression of mitochondrial energy metabolism genes; (ii) Induction of GPAT1 and taffazin in diabetic cardiomyocytes thereby initiating de novo phospholipid synthesis and remodeling in the mitochondrial membrane; and (iii) Altered fate of fatty acid in diabetic cardiomyocytes, influencing uptake, fatty acid oxidation and ATP synthesis. Further, Applicants combined the power of wet lab biology and AI based data mining platform to generate causal network based on bayesian models. Networks of proteins and lipids that are causal for loss of normal cell function were used to discern mechanisms of drug induced toxicity from cellular protective mechanisms. This novel approach will serve as a powerful new tool to understand mechanism of toxicity while allowing for development of safer therapeutics that correct an altered phenotype.

Human cardiomyocytes were subject to conditions simulating an diabetic environment experienced by the disease-relevant cells in vivo. Specifically, the cells were exposed to hyperglycemic conditions and hyperlipidemia conditions. The hyperglycemic condition was induced by culturing cells in media containing 22 mM glucose. The hyperlipidemia condition was induced by culturing the cells in media containing 1 mM L-carnitine, 0.7 mM Oleic acid and 0.7 mM Linoleic acid.

The cell model comprising the above-mentioned cells, wherein the cells were exposed to each condition described above, was additionally "interrogated" by exposing the cells to an "environmental perturbation" by treating with a diabetic drug (T) which is known to cause cardiotoxicity, a rescue molecule (R) or both the diabetic drug and the rescue molecule (T+R). Specifically, the cells were treated with diabetic drug; or treated with rescue molecule Coenzyme Q10 at 0, 50 µM, or 100 µM; or treated with both of the diabetic drug and the rescue molecule Coenzyme Q10.

Cell samples from each condition with each perturbation treatment were collected at various times following treatment, including after 6 hours of treatment. For certain conditions, media samples were also collected and analyzed.

iProfiling of changes in total cellular protein expression by quantitative proteomics was performed for cell and media samples collected for each condition and with each "environmental perturbation", i.e, diabetic drug treatment, Coenzyme Q10 treatment or both, using the techniques described above in the detailed description. Transcriptional profiling experiments were carried out using the Biorad cfx-384 amplification system. Following data collection (Ct), the final fold change over control was determined using the δCt method as outlined in manufacturer's protocol. Lipidomics experiments were carried out using mass spectrometry. Functional assays such as Oxygen consumption rate OCR were measured by employing the Seahorse analyzer essentially as recommended by the manufacturer. OCR was recorded by the electrodes in a 7 µl chamber created with the cartridge pushing against the seahorse culture plate.

Figure 20:
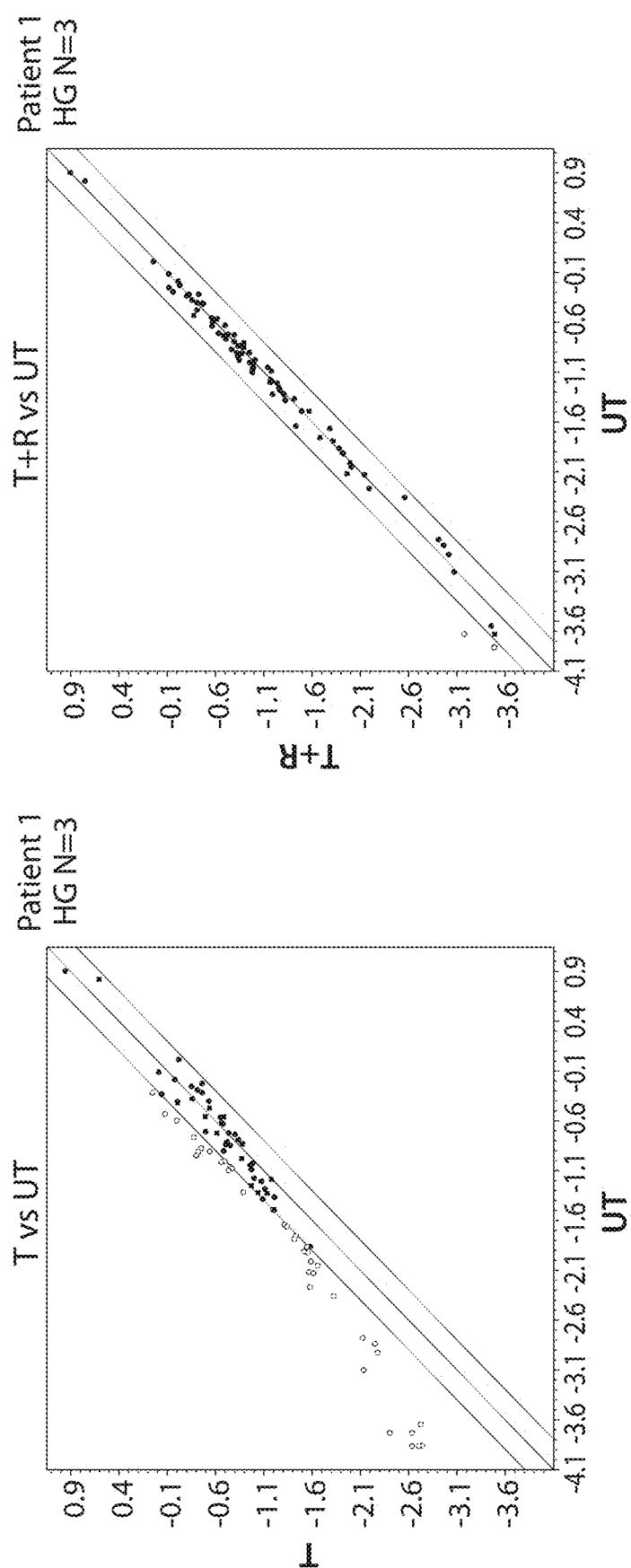
FIG. 20: Dysregulation of transcriptional network and expression of human mitochondrial energy metabolism genes in diabetic cardiomyocytes by drug treatment (T): rescue molecule (R) normalizes gene expression.

As shown in FIG. 20, transcriptional network and expression of human mitochondrial energy metabolism genes in diabetic cardiomyocytes (cardiomyocytes conditioned in hyperglycemic and hyperlipidemia) were compared between perturbed and unperturbed treatments. Specifically, data of transcriptional network and expression of human mitochondrial energy metabolism genes were compared between diabetic cardiomyocytes treated with diabetic drug (T) and untreated diabetic cardiomyocytes samples (UT). Data of Transcriptional network and expression of human mitochondrial energy metabolism genes were compared between diabetic cardiomyocytes treated with both diabetic drug and rescue molecule Coenzyme Q10 (T+R) and untreated diabetic cardiomyocytes samples (UT). Comparing to data from untreated diabetic cardiomyocytes, certain genes expression and transcription were altered when diabetic cardiomyocytes were treated with diabetic drug. Rescue molecule Coenzyme Q10 was demonstrated to reverse the toxic effect of diabetic drug and normalize gene expression and transcription.

Figure 21A:
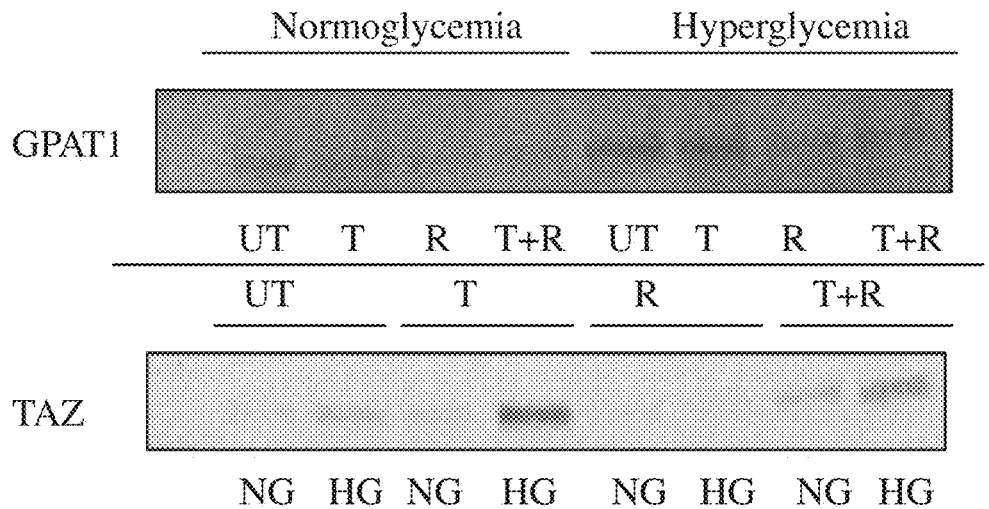
FIG. 21A: Drug treatment (T) induced expression of GPAT1 and TAZ in mitochondria from cardiomyocytes conditioned in hyperglycemia. In combination with the rescue molecule (T+R) the levels of GPAT1 and TAZ were normalized.
Figure 21B:
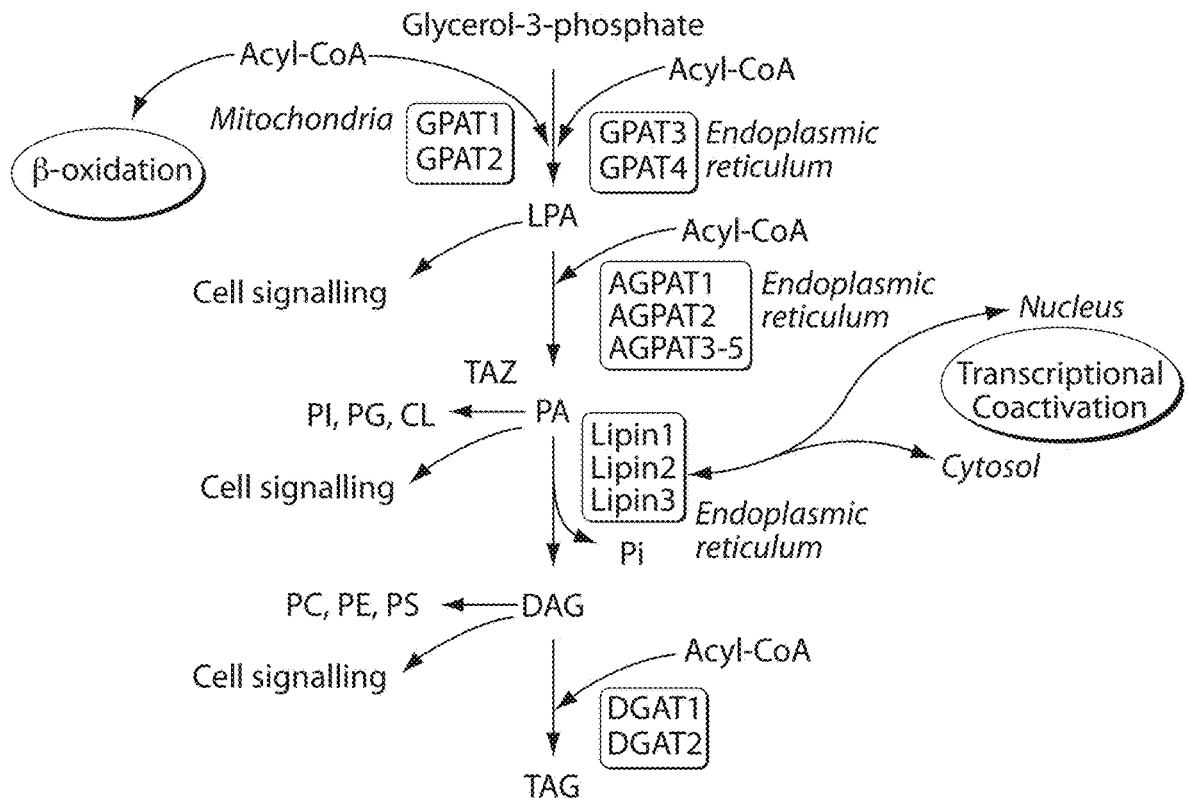
FIG. 21B: Synthesis of TAG from G3P.

As shown in FIG. 21A, cardiomyocytes were cultured either in normoglycemia (NG) or hyperglycemia (HG) condition and treated with either diabetic drug alone (T) or with both diabetic drug and rescue molecule Coenzyme Q10 (T+R). Protein expression levels of GPAT1 and TAZ for each condition and each treatment were tested with western blotting. Both GPAT1 and TAZ were upregulated in hyperglycemia conditioned and diabetic drug treated cardiomyocytes. When hyperglycemia conditioned cardiomyocytes were treated with both diabetic drug and rescue molecule Coenzyme Q10, the upregulated protein expression level of GPAT1 and TAZ were normalized.

Figure 22A:
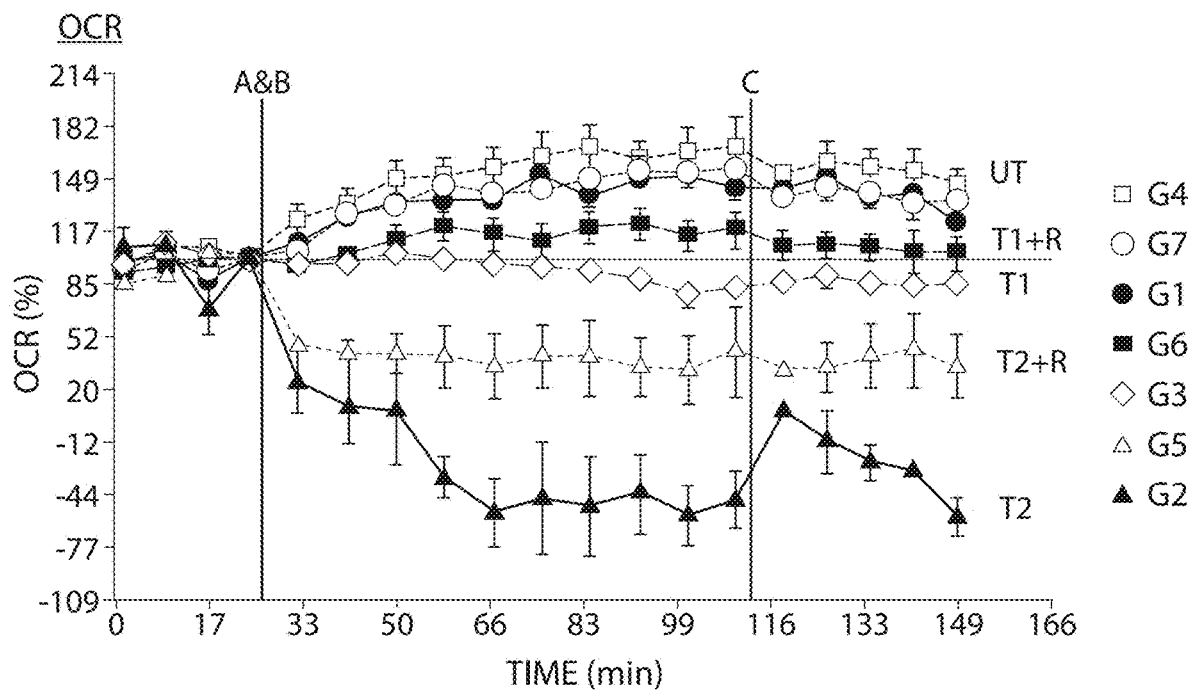
FIG. 22A: Drug treatment (T) decreases mitochondrial OCR (oxygen consumption rate) in cardiomyocytes conditioned in hyperglycemia. The rescue molecule (T+R) normalizes OCR.

As shown in FIG. 22A, mitochondrial oxygen consumption rate (%) experiments were carried out for hyperglycemia conditioned cardiomyocytes samples. Hyperglycemia conditioned cardiomyocytes were either untreated (UT), treated with diabetic drug T1 which is known to cause cardiotoxicity, treated with diabetic drug T2 which is known to cause cardiotoxicity, treated with both diabetic drug T1 and rescue molecule Coenzyme Q10 (T1+R), or treated with both diabetic drug T2 and rescue molecule Coenzyme Q10 (T2+R). Comparing to untreated control samples, mitochondrial OCR was decreased when hyperglycemia conditioned cardiomyocytes were treated with diabetic drug T1 or T2. However, mitochondrial OCR was normalized when hyperglycemia conditioned cardiomyocytes were treated with both diabetic drug and rescue molecule Coenzyme Q10 (T1+R, or T2+R).

Figure 22B:
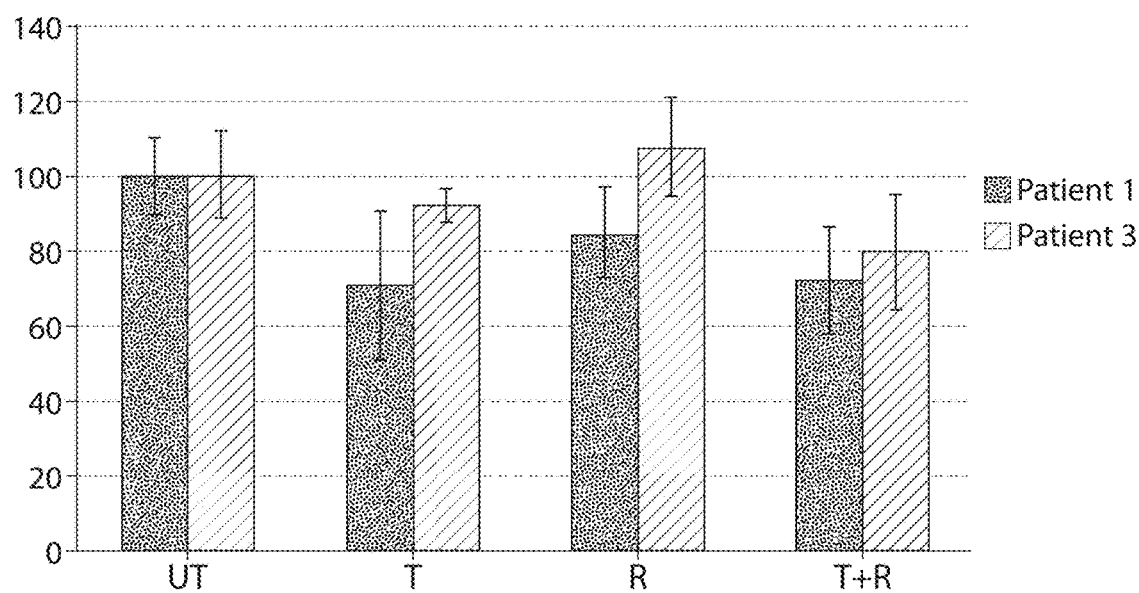
FIG. 22B: Drug treatment (T) represses mitochondrial ATP synthesis in cardiomyocytes conditioned in hyperglycemia.

As shown in FIG. 22B, mitochondria ATP synthesis experiments were carried out for hyperglycemia conditioned cardiomyocytes samples. Hyperglycemia conditioned cardiomyocytes were either untreated (UT), treated with a diabetic drug (T), or treated with both diabetic drug and rescue molecule Coenzyme Q10 (T+R). Comparing to untreated control samples, mitochondrial ATP synthesis was repressed when hyperglycemia conditioned cardiomyocytes were treated with diabetic drug (T).

Figure 23:
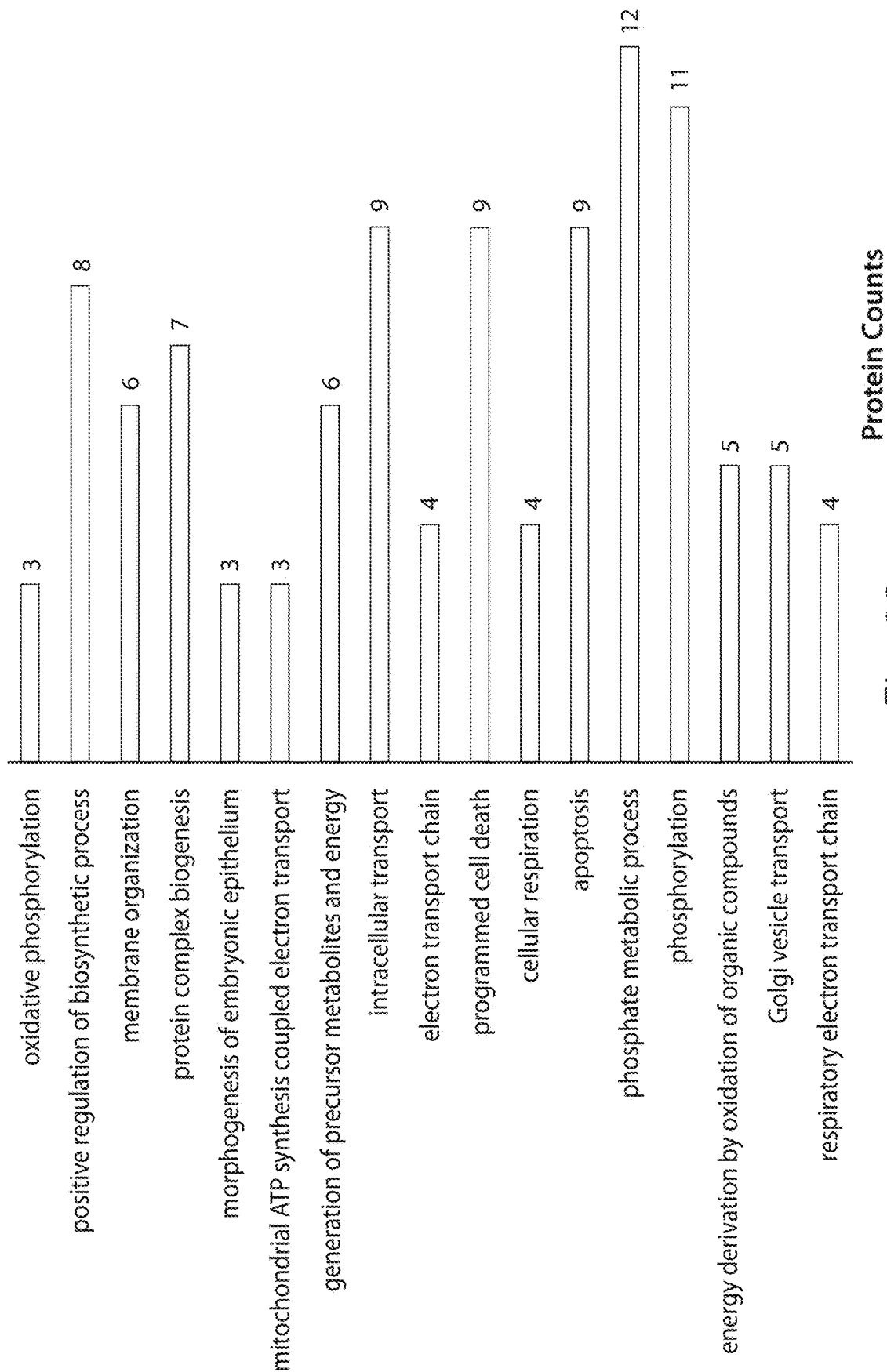
FIG. 23: GO Annotation of proteins down regulated by drug treatment. Proteins involved in mitochondrial energy metabolism were down regulated with drug treatment.

As shown in FIG. 23, based on the collected proteomic data, proteins down regulated by drug treatment were annotated with GO terms. Proteins involved in mitochondrial energy metabolism were down regulated when hyperglycemia conditioned cardiomyocytes were treated with a diabetic drug which is known to cause cardiotoxicity.

Proteomics, lipidomics, transcriptional profiling, functional assays, and western blotting data collected for each condition and with each perturbation, were then processed by the REFS™ system. Composite perturbed networks were generated from combined data obtained from one specific condition (e.g., hyperglycemia, or hyperlipidemia) exposed to each perturbation (e.g., diabetic drug, CoQ10, or both). Composite unperturbed networks were generated from combined data obtained from the same one specific condition (e.g., hyperglycemia, or hyperlipidemia), without perturbation (untreated). Similarly, composite perturbed networks were generated from combined data obtained for a second, control condition (e.g., normal glycemia) exposed to each perturbation (e.g., diabetic drug, CoQ10, or both). Composite unperturbed networks were generated from combined data obtained from the same second, control condition (e.g., normal glycemia), without perturbation (untreated).

Each node in the consensus composite networks described above was simulated (by increasing or decreasing by 10-fold) to generate simulation networks using REFS™, as described in detail above in the detailed description.

The area under the curve and fold changes for each edge connecting a parent node to a child node in the simulation networks were extracted by a custom-built program using the R programming language, where the R programming language is an open source software environment for statistical computing and graphics.

Delta networks were generated from the simulated composite networks. To generate a drug induced cardiotoxicity condition vs. normal condition differential network in response to the diabetic drug (delt network), steps of comparison were performed as illustrated in FIG. 24, by a custom built program using the PERL programming language.

Figure 24:
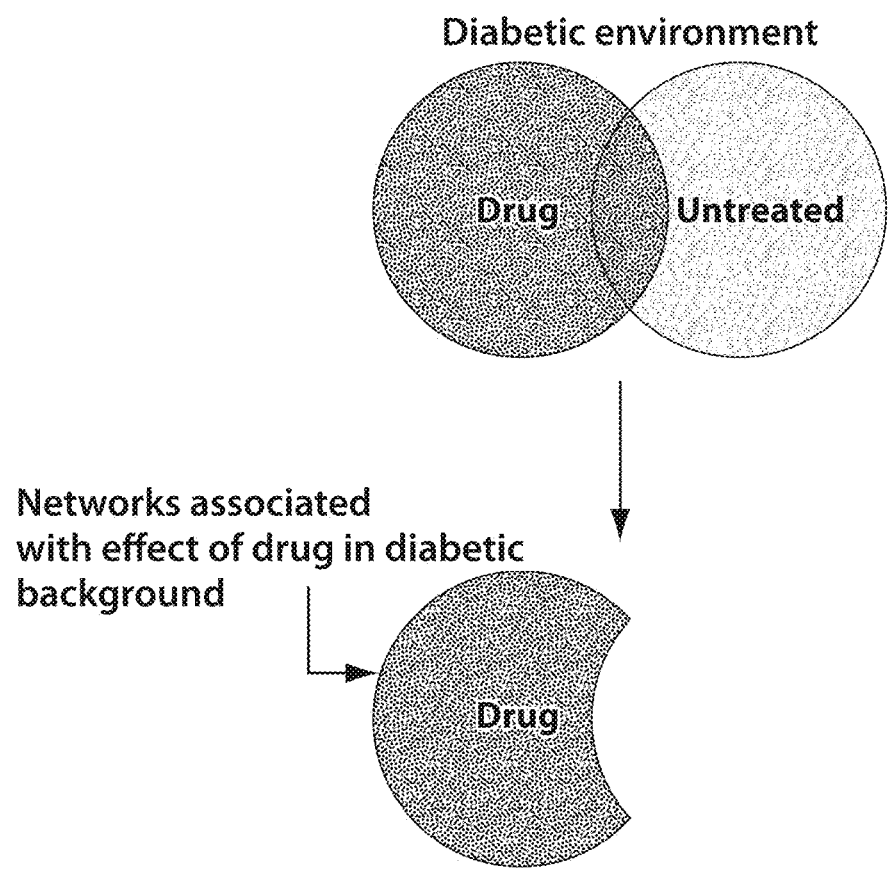
FIG. 24: Illustration of the mathematical approach towards generation of delta networks. Compare unique edges from T versus UT both the models being in diabetic environment.

Specifically, as shown in FIG. 24, Untreated refers to protein expression networks of untreated control cardiomyocytes in hyperglycemia condition. Drug refers to protein expression networks of diabetic drug treated cardiomyocytes in hyperglycemia condition. Unique edges from Drug in the Drug∩Untreated delta network are presented in FIG. 25.

Figure 25:
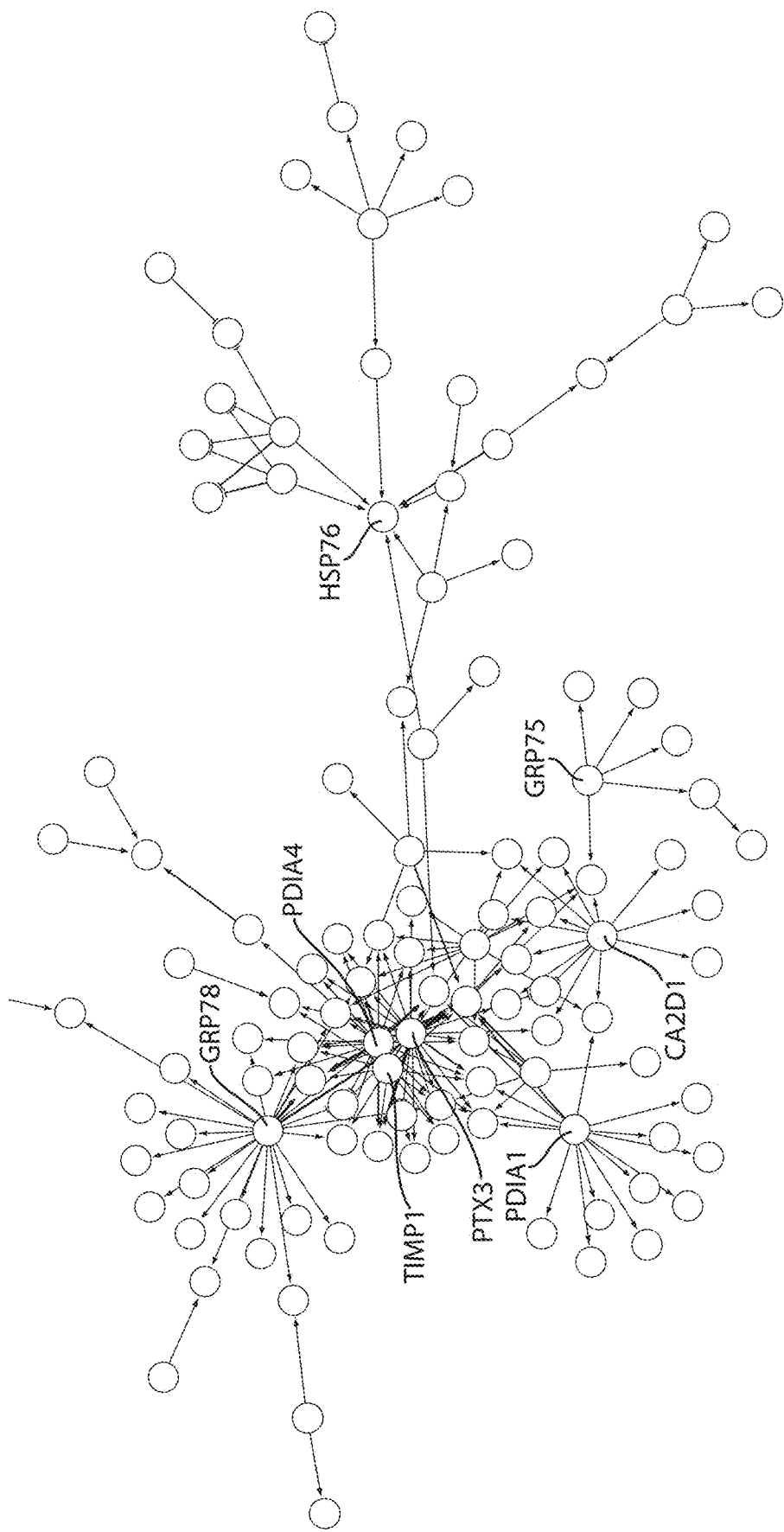
FIG. 25: A schematic representing potential protein hubs and networks that drive pathophysiology of drug induced toxicity.
Figure 26:
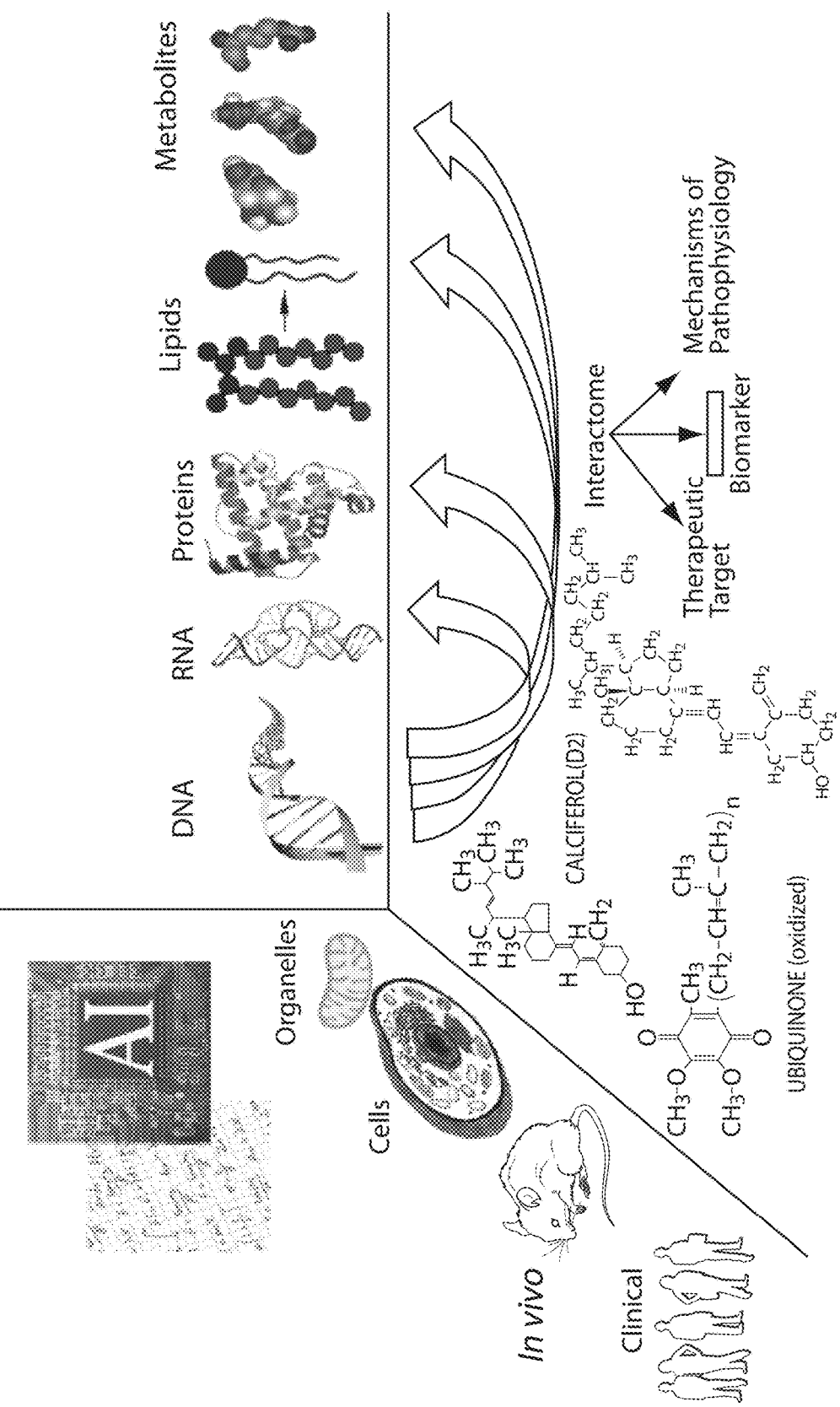
FIG. 26: Schematic representation of the Interrogative biology platform.
Figure 27:
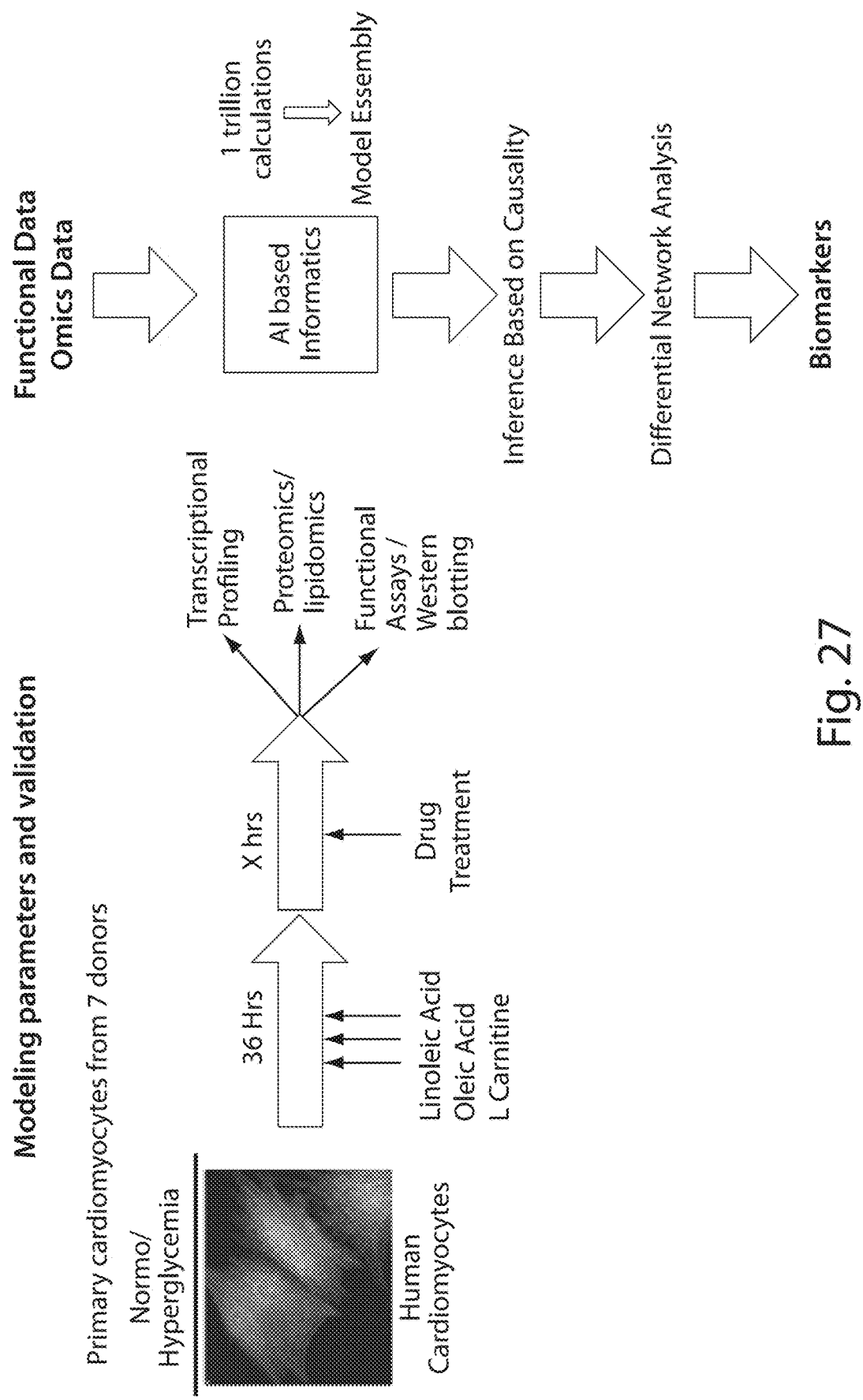
FIG. 27: Illustration of cellular functional models, data integration and mathematical model Building.
Figure 28:
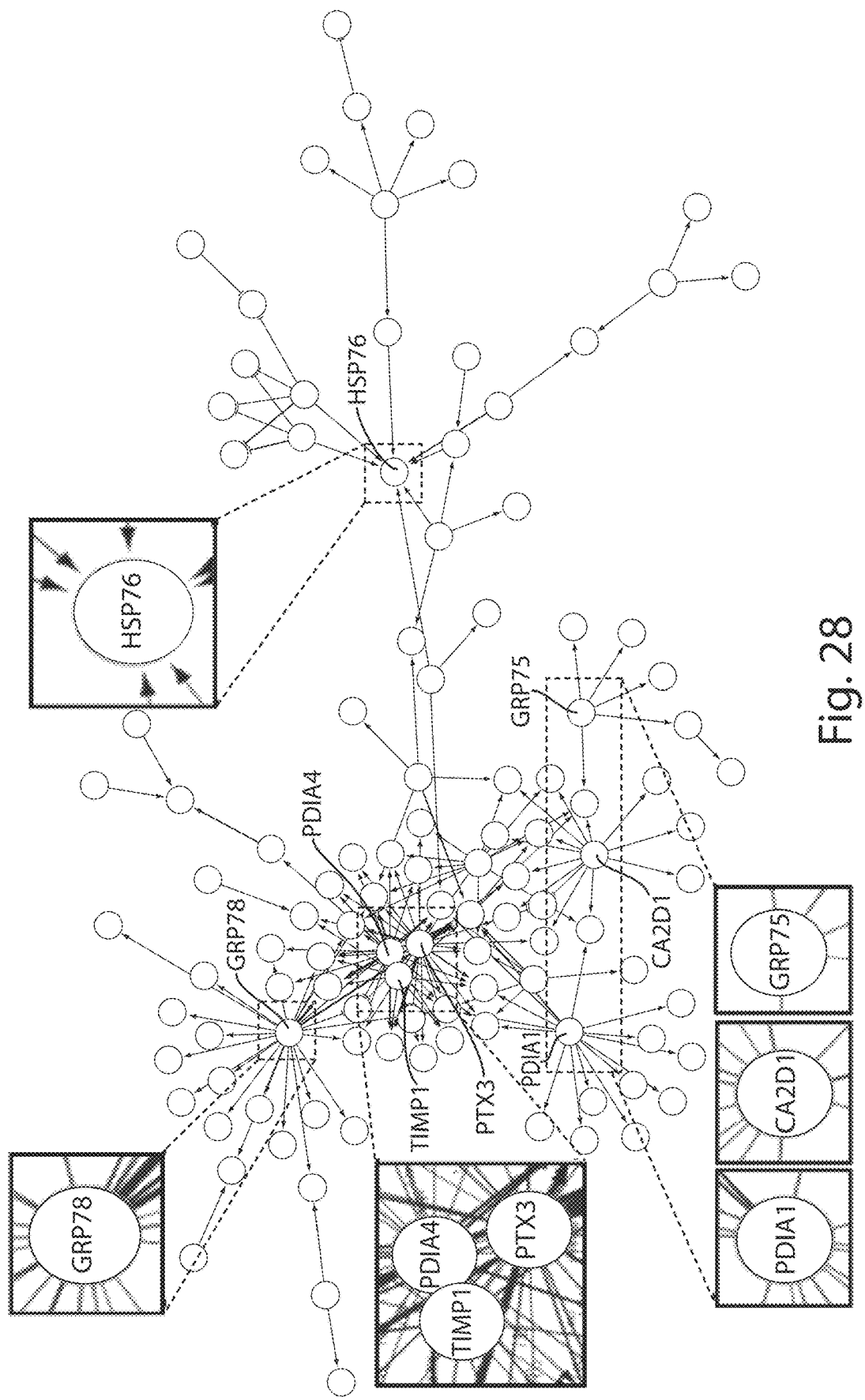
FIG. 28: Causal molecular interaction network that drives pathophysiology of drug-induced toxicity.
Figure 29:
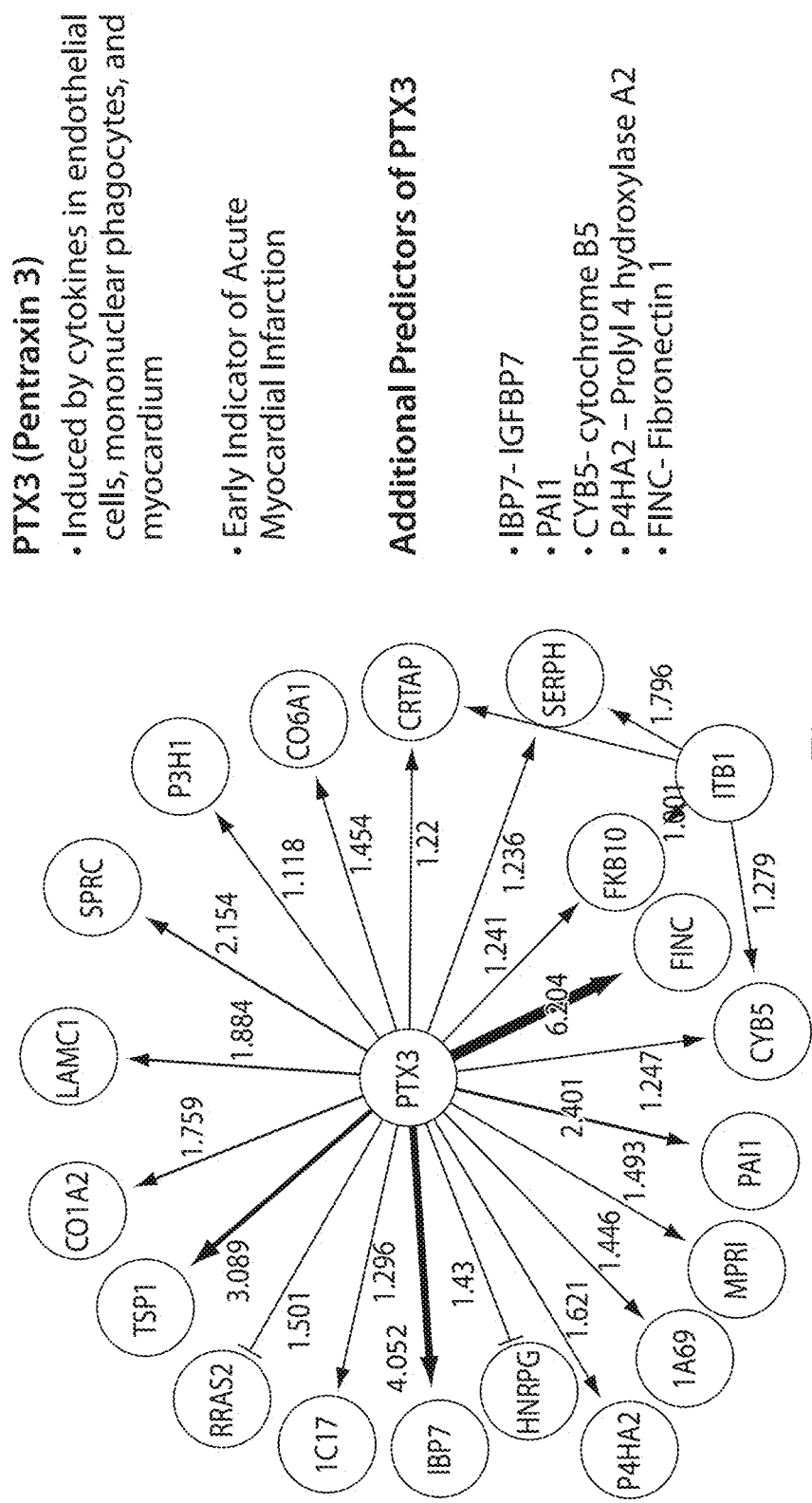
FIG. 29: Causal molecular interaction sub-network of PTX3 as the central hub that drives pathophysiology of drug-induced toxicity.

Specifically, a simulated composite map of untreated cardiomyocytes in hyperglycemia condition and a simulated composite map of diabetic drug treated cardiomyocytes in hyperglycemia condition were compared using a custom-made Perl program to generate unique edges of the diabetic drug treated cardiomyocytes in hyperglycemia condition. Output from the PERL and R programs were input into Cytoscape, an open source program, to generate a visual representation of the delta network. As shown in FIG. 25, the network represents delta networks that are driven by the diabetic drug versus untreated in cardiomyocytes/cardiotox models in hyperglycemia condition.

From the drug induced toxicity condition vs. normal condition differential network shown in FIG. 25, proteins were identified which drive pathophysiology of drug induced cardiotoxicity, such as GRP78, GRP75, TIMP1, PTX3, HSP76, PDIA4, PDIA1, CA2D1. These proteins can function as biomarkers for identification of other cardiotoxicity inducing drugs. These proteins can also function as biomarkers for identification of agents which can alleviate cardiotoxicity.

The experiments described in this Example demonstrate that perturbed membrane biology and altered fate of free fatty acid in diabetic cardiomyocytes exposed to drug treatment represent the center piece of drug induced toxicity. Data integration and network biology have allowed for an enhanced understanding of cardiotoxicity, and identification of novel biomarkers predictive for cardiotoxicity.

Figure 30:
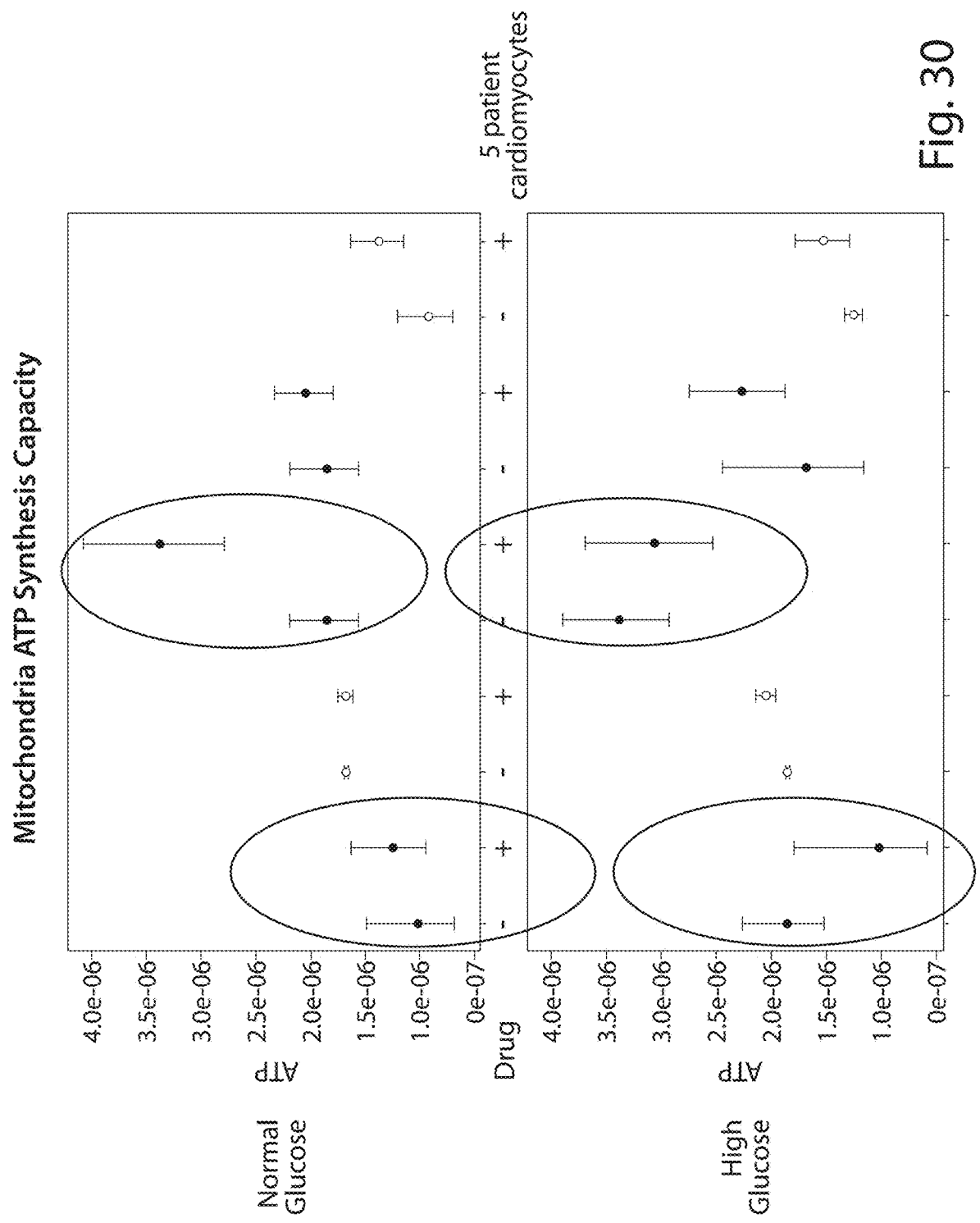
FIG. 30: Mitochondria ATP synthesis capacity of cardiomyocytes in normal glucose and high glucose conditions.
Figure 31A:
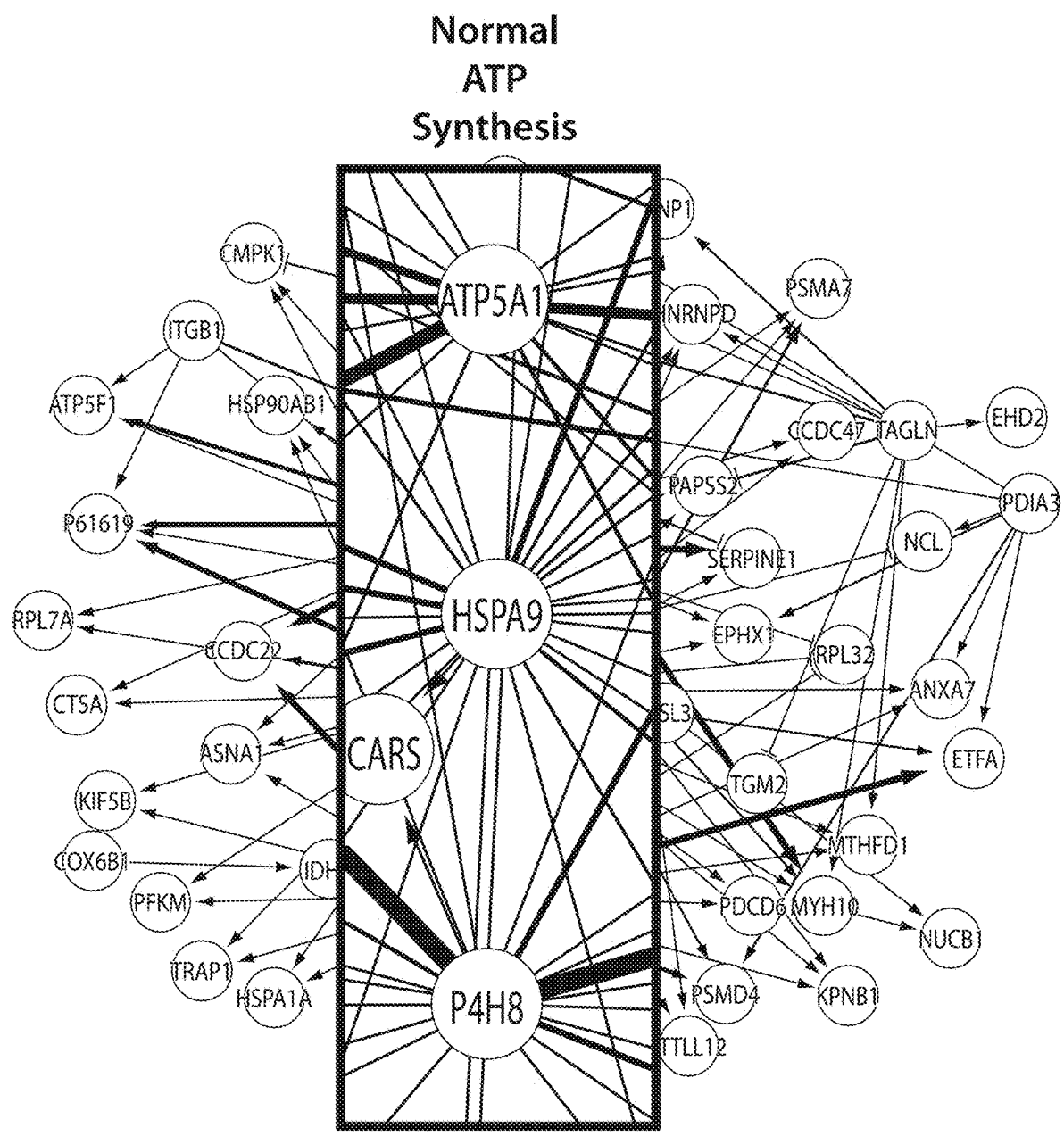
FIG. 31A: Causal molecular interaction network of ATP drivers for normal ATP synthesis.
Figure 31B:
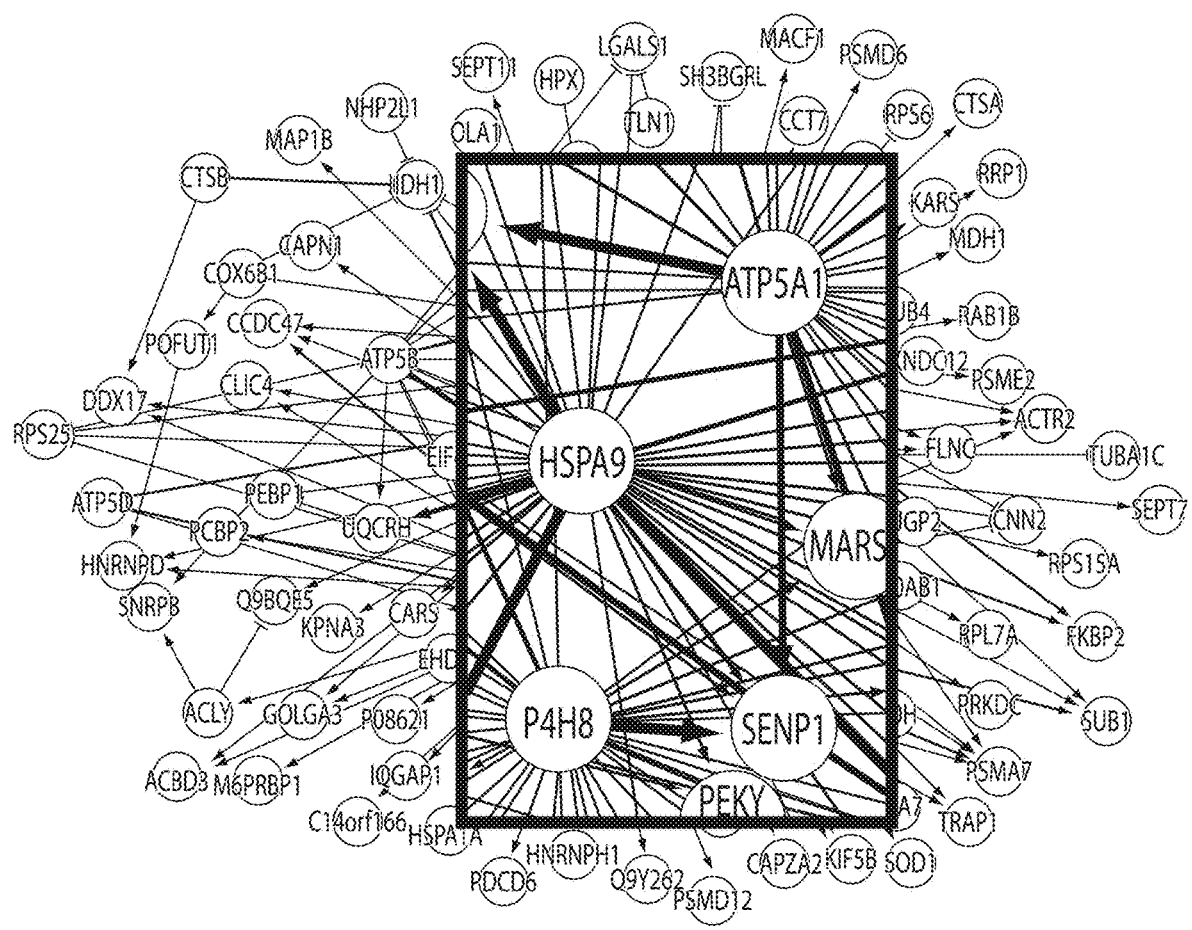
FIG. 31B: Causal molecular interaction network of ATP drivers for reduced ATP synthesis.
Figure 32:
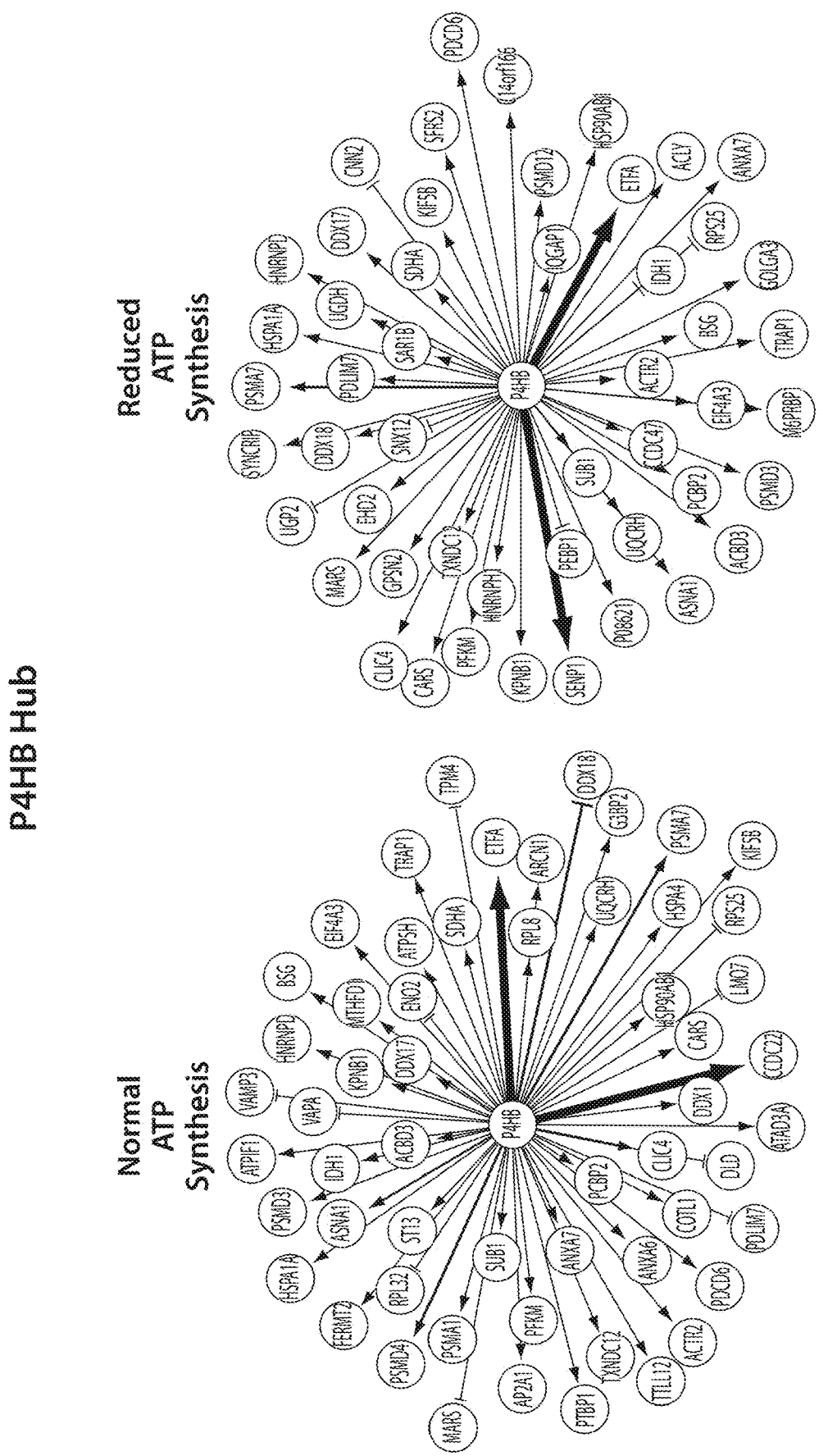
FIG. 32: Causal molecular interaction sub-network of ATP drivers with P4HB as the central hub.
Figure 33:
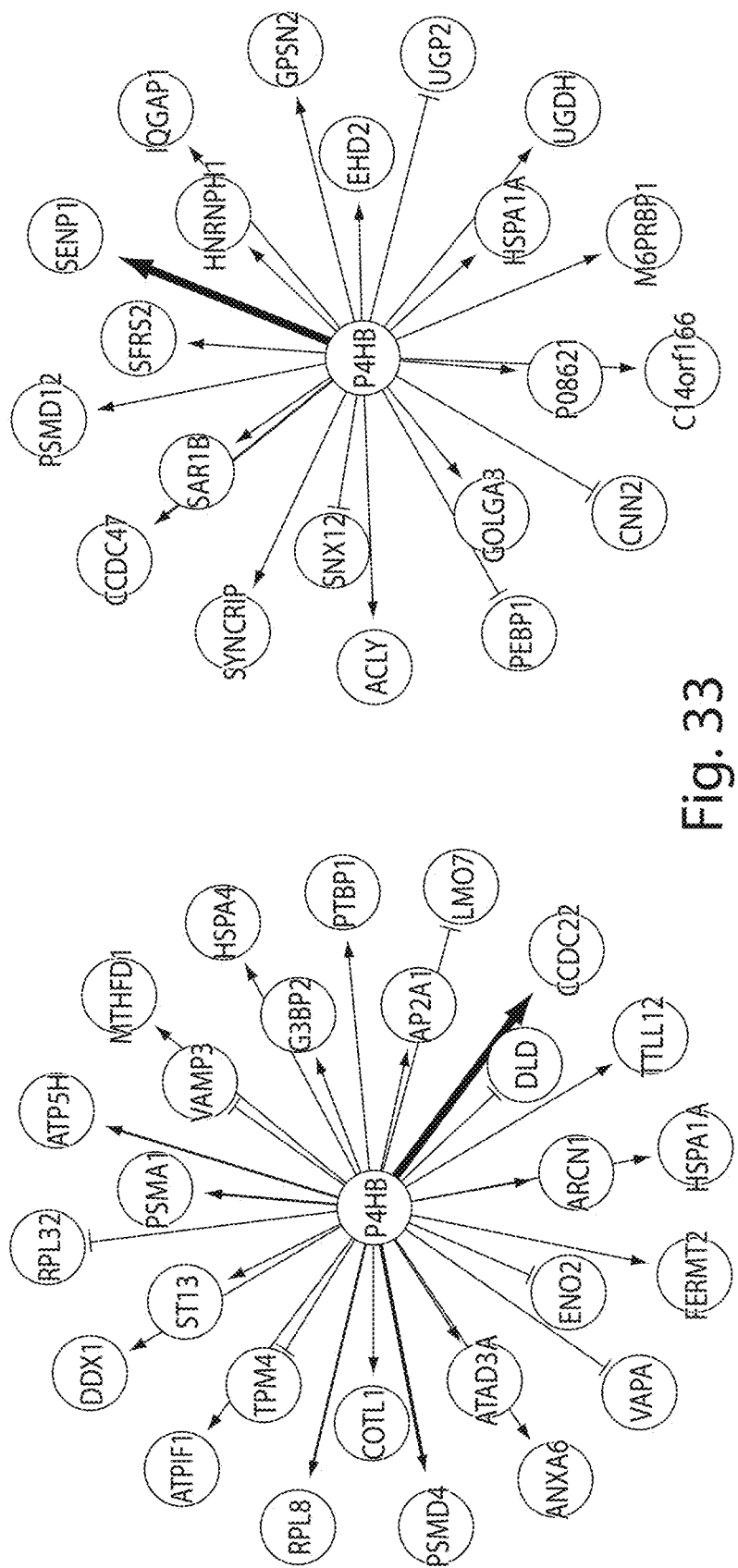
FIG. 33: Unique edges of causal molecular interaction sub-network of ATP drivers with P4HB as the central hub.
Figure 34:
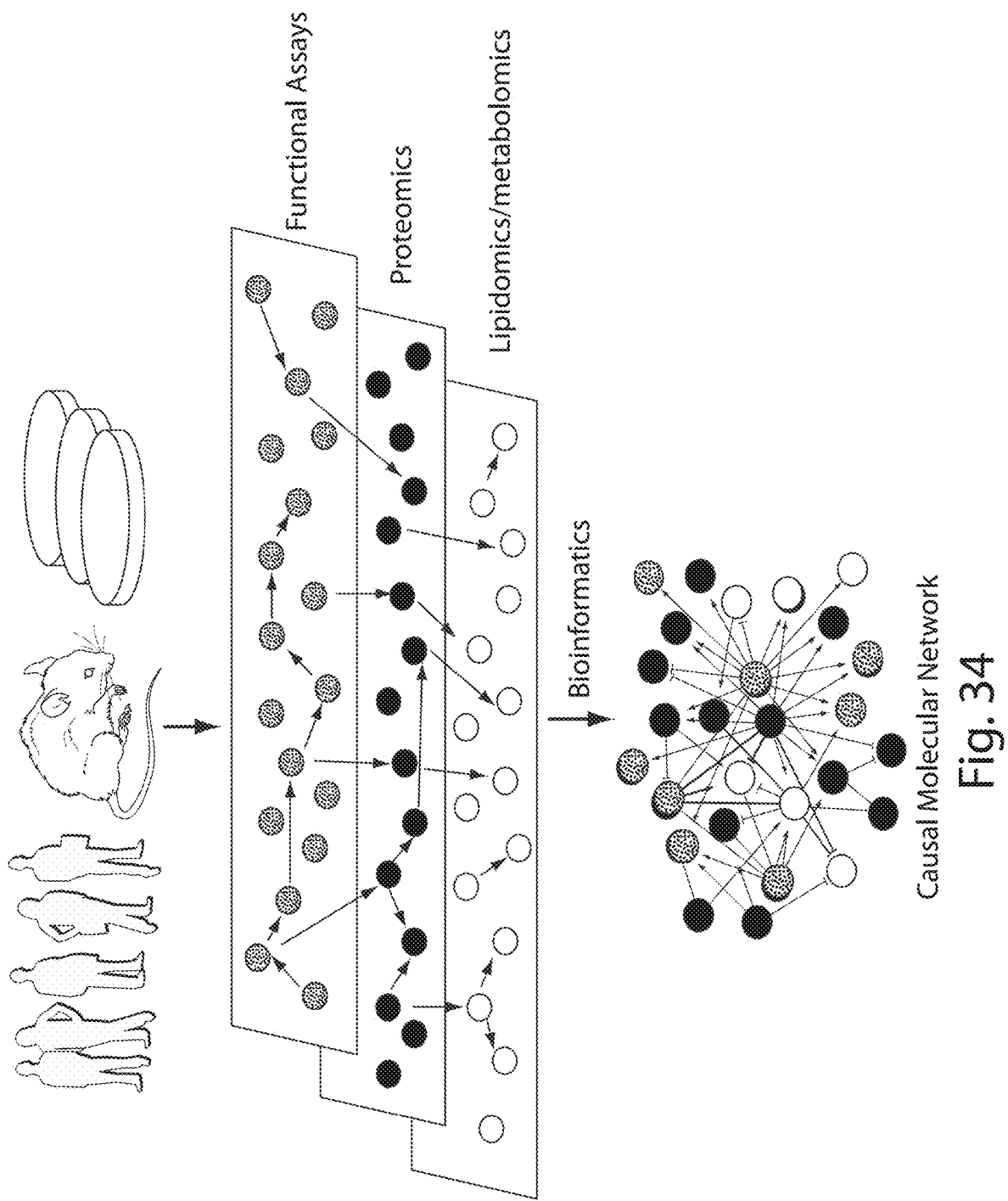
FIG. 34: Illustration of functional toxicomics: multi-omics integration.

Example 2: Employing Models of Drug Induced Cardiotoxicity to Identify Additional Markers of Cardiotoxicity The platform technology described above in Example 1 was similarly employed to integrate further data obtained from the same custom built cardiotoxicity model. Five patient cardiomyocyte lines were used to create a model of cardiotoxicity as explained in the above-detailed description. The five cardiomyocyte lines were then subjected to a mitochondrial ATP assay to assay for mitochondrial dysfunction imposed by drug treatment or absence there of (as indicated as + and −) under diabetic conditions (hyperglycemia) and normal conditions (normoglycemia). A reduction of mitochondrial ATP was observed under diabetic conditions upon drug treatment in only 2 out of the 5 cardiotoxicity model (see FIG. 30). The results of these further experiments lead to the identification of additional novel proteins/pathways driving the pathogenesis of cardiotoxicity of drugs, as summarized in FIGS. 26-34.

The causal interaction network identified several novel biomarkers and potential therapeutic targets for drug-induced cardiotoxicity. Relational maps resulting from this analysis as shown in FIGS. 28, 29, 31-33 have provided additional drug-induced cardiotoxicity biomarkers, which are listed below in Table 2. These biomarkers may be used for predicting drug-induced cardiotoxicity of a drug, for diagnosis/prognosis of drug-induced cardiotoxicity, and for identifying a rescue agent which can reduce or alleviate drug-induced cardiotoxicity.

TABLE 2

| biomarkers identified by the Interrogative Biology Discovery Platform |
|---|
| 1A69, 1C17, ACBD3, ACLY, ACTR2, ANXA6, ANXA7, AP2A1, ARCN1, ASNA1, ATAD3A, ATP5A, ATP5B, ATP5D, ATP5F1, ATP5H, ATPIF1, BSG, Cl4orf166, CA2D1, CAPN1, CAPZA2, CARS, CCDC22, CCDC47, CCT7, CLIC4, CMPK1, CNN2, CO1A2, CO6A1, COTL1, COX6B1, CRTAP, CS010, CTSA, CTSB, CYB5, DDX1, DDX17, DDX18, DLD, EDIL3, EHD2, EIF4A3, ENO2, EPHX1, ETFA, FERMT2, FINC, FKB10, FKBP2, FLNC, G3BP2, GOLGA3, GPAT1, GPSN2, GRP75, GRP78, HMOX1, HNRNPD, HNRNPH1, HNRPG, HPX, HSP76, HSP90AB1, HSPA1A, HSPA4, HSPA9, IBP7, IDH1, IQGAP1, ITB1, ITGB1, KARS, KIF5B, KPNA3, KPNB1, LAMC1, LGALS1, LMO7, M6PRBP1, MACF1, MAP1B, MARS, MDH1, MPR1, MTHFD1, MYH10, NCL, NHP2L1, NUCB1, OLA1, P08621, P3H1, P4HA2, P4HB, SEC61A1 (P61619), PAI1, PAPSS2, PCBP2, PDCD6, PDIA1, PDIA3, PDIA3, PDIA4, PDLIM7, PEBP1, PFKM, PH4B, PLIN2, POFUT1, PRKDC, PSMA1, PSMA7, PSMD12, PSMD3, PSMD4, PSMD6, PSME2, PTBP1, PTX3, Q9BQE5, Q9Y262, RAB1B, RP515A, RPL32, RPL7A, RPL8, RPS25, RPS6, RRAS2, RRP1, SAR1B, SDHA, SENP1, SEPT11, SEPT7, SERPH, SERPINE1, SFRS2, SH3BGRL, SNRPB, SNX12, SOD1, SPRC, ST13, SUB1, SYNCRIP, TAGLN, TAZ, TGM2, TIMP1, TLN1, TPM4, TRAP1, TSP1, TTLL12, TXNDC12, UBA1C, UGDH, UGP2, UQCRH, VAMP3, VAPA |

In one embodiment, a panel of two, three, four, five, six, seven, eight, nine, ten, eleven, twelve, or thirteen markers selected from a group consisting TIMP1, PTX3, HSP76, FINC, CYB5, PAI1, IBP7 (IGFBP7), 1C17, EDIL3, HMOX1, NUCB1, CS010, HSPA4 can be used for predicting drug-induced cardiotoxicity of a drug, for diagnosis/prognosis of drug-induced cardiotoxicity, for identifying a rescue agent which can reduce or alleviate drug-induced cardiotoxicity.

Among the markers listed in Table 2, PTX3, PAI1, IBP7 (IGFBP7) have been reported as markers of cardiomyopathy previously. GRP78 and PDIA3 have been reported as serving important indications of ER stress and hypoxic insult. The fact that these markers have been identified by the above-described platform technology for drug-induced cardiotoxicity, have validated this platform technology for probing novel drug-induced cardiotoxicity biomarkers.

The sDNA sequences of the markers listed in Table 2 are set forth in Appendix A, and are known in the art.

INCORPORATION BY REFERENCE

The contents of all cited references (including literature references, patents, patent applications, and websites) that maybe cited throughout this application are hereby expressly incorporated by reference in their entirety, as are the references cited therein. The practice of the present invention will employ, unless otherwise indicated, conventional techniques of protein formulation, which are well known in the art.

EQUIVALENTS

The invention may be embodied in other specific forms without departing from the spirit or essential characteristics thereof. The foregoing embodiments are therefore to be considered in all respects illustrative rather than limiting of the invention described herein. Scope of the invention is thus indicated by the appended claims rather than by the foregoing description, and all changes that come within the meaning and range of equivalency of the claims are therefore intended to be embraced herein.

Appendix A

Grp78

Official Symbol: HSPA5

Official Name: heat shock 70kDa protein 5 (glucose-regulated protein, 78kDa)

Gene ID: 3309

Organism: Homo sapiens

Other Aliases: BIP; MIF2; GRP78

Other Designations: 78 kDa glucose-regulated protein; endoplasmic reticulum lumenal Ca(2+)-binding protein grp78; immunoglobulin heavy chain-binding protein Nucleotide sequence:

NCBI Reference Sequence: NM_005347.4

LOCUS    NM_005347

ACCESSION   NM_005347

(SEQ ID NO: 1)

Protein sequence:

NCBI Reference Sequence: NP_005338.1

LOCUS    NP_005338

ACCESSION   NP_005338

(SEQ ID NO: 2)

Grp75

Official Symbol: HSPA9

Official Name: heat shock 70kDa protein 9 (mortalin)

Gene ID: 3313

Organism: Homo sapiens

Other Aliases: CSA; MOT; MOT2; GRP75; PBP74; GRP-75; HSPA9B; MTHSP75

Other Designations: 75 kDa glucose-regulated protein; heat shock 70kD protein 9B; mortalin, perinuclear; mortalin-2; p66-mortalin; peptide-binding protein 74; stress-70 protein, mitochondrial Nucleotide sequence:

NCBI Reference Sequence: NM_004134.6

LOCUS    NM_004134

ACCESSION   NM_004134

(SEQ ID NO: 3)

Protein sequence:

NCBI Reference Sequence: NP_004125.3

LOCUS    NP_004125

ACCESSION   NP_004125

(SEQ ID NO: 4)

TIMP1

Official Symbol: TIMP1

Official Name: TIMP metallopeptidase inhibitor 1

Gene ID: Gene ID: 7076

Organism: Homo sapiens

Other Aliases: RP1-230G1.3, CLGI, EPA, EPO, HCI, TIMP

Other Designations: TIMP-1; collagenase inhibitor; erythroid potentiating activity; erythroid-potentiating activity; fibroblast collagenase inhibitor; metalloproteinase inhibitor 1; tissue inhibitor of metalloproteinases 1

Nucleotide sequence:

NCBI Reference Sequence: NM_003254.2

LOCUS    NM_003254

ACCESSION NM_003254

(SEQ ID NO: 5)

Protein sequence:

NCBI Reference Sequence: NP_003245.1

LOCUS    NP_003245

ACCESSION NP_003245

(SEQ ID NO: 6)

PTX3

Official Symbol: PTX3

Official Name: pentraxin 3, long

Gene ID: 5806

Organism: Homo sapiens

Other Aliases: TNFAIP5, TSG-14

Other Designations: TNF alpha-induced protein 5; pentaxin-related gene, rapidly induced by IL-1 beta, tumor necrosis factor, alpha-induced protein 5; pentaxin-related protein PTX3; pentraxin-3; pentraxin-related gene, rapidly induced by IL-1 beta; pentraxin-related protein PTX3; tumor necrosis factor alpha-induced protein 5; tumor necrosis factor, alpha-induced protein 5; tumor necrosis factor-inducible gene 14 protein; tumor necrosis factor-inducible protein TSG-14

Nucleotide sequence:

NCBI Reference Sequence: NM_002852.3

LOCUS    NM_002852

ACCESSION    NM_002852

(SEQ ID NO: 7)

Protein sequence:

NCBI Reference Sequence: NP_002843.2

LOCUS    NP_002843

ACCESSION   NP_002843

(SEQ ID NO: 8)

HSP76

Official Symbol: HSPA6

Official Name: heat shock 70kDa protein 6 (HSP70B')

Gene ID: 3310

Organism: Homo sapiens

Other Aliases:

Other Designations: heat shock 70 kDa protein 6; heat shock 70 kDa protein B'; heat shock 70kD protein 6 (HSP70B')

Nucleotide sequence:

NCBI Reference Sequence: NM_002155.3

LOCUS    NM_002155

ACCESSION   NM_002155

(SEQ ID NO: 9)

Protein sequence:

NCBI Reference Sequence: NP_002146.2

LOCUS    NP_002146

ACCESSION   NP_002146

(SEQ ID NO: 10)

PDIA4

Official Symbol: PDIA4

Official Name: protein disulfide isomerase family A, member 4

Gene ID: 9601

Organism: Homo sapiens

Other Aliases: ERP70, ERP72, ERp-72

Other Designations: ER protein 70; ER protein 72; endoplasmic reticulum resident protein 70; endoplasmic reticulum resident protein 72; protein disulfide isomerase related protein (calcium-binding protein, intestinal-related); protein disulfide isomerase-associated 4; protein disulfide-isomerase A4

Nucleotide sequence:

NCBI Reference Sequence: NM_004911.4

LOCUS    NM_004911

ACCESSION    NM_004911

(SEQ ID NO: 11)

Protein sequence:

NCBI Reference Sequence: NP_004902.1

LOCUS    NP_004902

ACCESSION    NP_004902

(SEQ ID NO: 12)

PDIA1

Official Symbol: P4HB

Official Name: prolyl 4-hydroxylase, beta polypeptide

Gene ID: 5034

Organism: Homo sapiens

Other Aliases: DSI, ERBA2L, GIT, P4Hbeta, PDI, PDIA1, PHDB, PO4DB, PO4HB, PROHB Other Designations: cellular thyroid hormone-binding protein; collagen prolyl 4-hydroxylase beta; glutathione-insulin transhydrogenase; p55; procollagen-proline, 2-oxoglutarate 4-dioxygenase (proline 4-hydroxylase), beta polypeptide; prolyl 4-hydroxylase subunit beta; protein disulfide isomerase family A, member 1; protein disulfide isomerase-associated 1; protein disulfide isomerase/oxidoreductase; protein disulfide-isomerase; protocollagen hydroxylase; thyroid hormone-binding protein p55

Nucleotide sequence:

NCBI Reference Sequence: NM_000918.3

LOCUS    NM_000918

ACCESSION    NM_000918

(SEQ ID NO: 13)

Protein sequence:

NCBI Reference Sequence: NP_000909.2

LOCUS    NP_000909

ACCESSION    NP_000909

(SEQ ID NO: 14)

CA2D1

Official Symbol: CACNA2D1

Official Name: calcium channel, voltage-dependent, alpha 2/delta subunit 1

Gene ID: 781

Organism: Homo sapiens

Other Aliases: H_DJ0560O14.1, CACNA2, CACNL2A, CCHL2A

Other Designations: calcium channel, L type, alpha 2 polypeptide; dihydropyridine-sensitive L-type, calcium channel alpha-2/delta subunit; voltage-dependent calcium channel subunit alpha-2/delta-1; voltage-gated calcium channel subunit alpha-2/delta-1

Nucleotide sequence:

NCBI Reference Sequence: NM_000722.2

LOCUS    NM_000722

ACCESSION   NM_000722

(SEQ ID NO: 15)

Protein sequence:

NCBI Reference Sequence: NP_000713.2

LOCUS    NP_000713

ACCESSION   NP_000713

(SEQ ID NO: 16)

GPAT1

Official Symbol: GPAM

Official Name: glycerol-3-phosphate acyltransferase, mitochondrial

Gene ID: 57678

Organism: Homo sapiens

Other Aliases: RP11-426E5.2, GPAT, GPAT1

Other Designations: GPAT-1; glycerol 3-phosphate acyltransferase, mitochondrial; glycerol-3-phosphate acyltransferase 1, mitochondrial Nucleotide sequence:

NCBI Reference Sequence: NM_001244949.

LOCUS    NM_001244949

ACCESSION   NM_001244949

(SEQ ID NO: 17)

Protein sequence:

NCBI Reference Sequence: NP_001231878.1

LOCUS    NP_001231878

ACCESSION   NP_001231878

(SEQ ID NO: 18)

TAZ

Official Symbol: TAZ

Official Name: tafazzin

Gene ID: 6901

Organism: Homo sapiens

Other Aliases: XX-FW83563B9.3, BTHS, CMD3A, EFE, EFE2, G4.5, LVNCX, Taz1

Other Designations: protein G4.5

Nucleotide sequence:

NCBI Reference Sequence: NM_000116.3

LOCUS    NM_000116

ACCESSION   NM_000116

(SEQ ID NO: 19)

Protein sequence:

NCBI Reference Sequence: NP_000107.1

LOCUS    NP_000107

ACCESSION   NP_000107

(SEQ ID NO: 20)

CO1A2

Official Symbol: COL1A2

Official Name: collagen, type I, alpha 2

Gene ID: 1278

Organism: Homo sapiens

Other Aliases: OI4

Other Designations: alpha 2(I)-collagen; alpha-2 type I collagen; collagen I, alpha-2 polypeptide; collagen alpha-2(I) chain; collagen of skin, tendon and bone, alpha-2 chain; type I procollagen Nucleotide sequence:

NCBI Reference Sequence: NM_000089.3

LOCUS    NM_000089

ACCESSION   NM_000089

(SEQ ID NO: 21)

Protein sequence:

NCBI Reference Sequence: NP_000080.2

LOCUS    NP_000080

ACCESSION  NP_000080

(SEQ ID NO: 22)

LAMC1

Official Symbol: LAMC1

Official Name: laminin, gamma 1 (formerly LAMB2)

Gene ID: 3915

Organism: Homo sapiens

Other Aliases: RP11-181K3.1, LAMB2

Other Designations: S-LAM gamma; S-laminin subunit gamma; laminin B2 chain; laminin subunit gamma-1; laminin-10 subunit gamma; laminin-11 subunit gamma; laminin-2 subunit gamma; laminin-3 subunit gamma; laminin-4 subunit gamma; laminin-6 subunit gamma; laminin-7 subunit gamma; laminin-8 subunit gamma; laminin-9 subunit gamma Nucleotide sequence:

NCBI Reference Sequence: NM_002293.3

LOCUS      NM_002293

ACCESSION   NM_002293

(SEQ ID NO: 23)

Protein sequence:

NCBI Reference Sequence: NP_002284.3

LOCUS    NP_002284

ACCESSION   NP_002284

(SEQ ID NO: 24)

SPRC

Official Symbol: SPARC

Official Name: secreted protein, acidic, cysteine-rich (osteonectin)

Gene ID: 6678

Organism: Homo sapiens

Other Aliases: ON

Other Designations: BM-40; basement-membrane protein 40; cysteine-rich protein; osteonectin; secreted protein acidic and rich in cysteine Nucleotide sequence:

NCBI Reference Sequence: NM_003118.3

LOCUS    NM_003118

ACCESSION  NM_003118

(SEQ ID NO: 25)

Protein sequence:

NCBI Reference Sequence: NP_003109.1

LOCUS    NP_003109

ACCESSION  NP_003109

(SEQ ID NO: 26)

P3H1

Official Symbol: LEPRE1

Official Name: leucine proline-enriched proteoglycan (leprecan) 1

Gene ID: 64175

Organism: Homo sapiens

Other Aliases: PSEC0109, GROS1, OI8, P3H1

Other Designations: growth suppressor 1; leprecan; leucine- and proline-enriched proteoglycan 1; prolyl 3-hydroxylase 1

Nucleotide sequence:

NCBI Reference Sequence: NM_001146289.1

LOCUS    NM_001146289

ACCESSION  NM_001146289

(SEQ ID NO: 27)

Protein sequence:

NCBI Reference Sequence: NP_001139761.1

LOCUS    NP_001139761

ACCESSION NP_001139761

(SEQ ID NO: 28)

CO6A1

Official Symbol: COL6A1

Official Name: collagen, type VI, alpha 1

Gene ID: 1291

Organism: Homo sapiens

Other Aliases: OPLL

Other Designations: alpha 1 (VI) chain (61 AA); collagen VI, alpha-1 polypeptide; collagen alpha-1(VI) chain Nucleotide sequence:

NCBI Reference Sequence: NM_001848.2

LOCUS    NM_001848

ACCESSION    NM_001848

(SEQ ID NO: 29)

Protein sequence:

NCBI Reference Sequence: NP_001839.2

LOCUS    NP_001839

ACCESSION NP_001839

(SEQ ID NO: 30)

CRTAP

Official Symbol: CRTAP

Official Name: cartilage associated protein

Gene ID: 10491

Organism: Homo sapiens

Other Aliases: CASP, LEPREL3, OI7

Other Designations: cartilage-associated protein; leprecan-like 3

Nucleotide sequence:

NCBI Reference Sequence: NM_006371.4

LOCUS    NM_006371

ACCESSION   NM_006371

(SEQ ID NO: 31)

Protein sequence:

NCBI Reference Sequence: NP_006362.1

LOCUS    NP_006362

ACCESSION   NP_006362

(SEQ ID NO: 32)

SERPH

Official Symbol: SERPINH1

Official Name: serpin peptidase inhibitor, clade H (heat shock protein 47), member 1, (collagen binding protein 1)

Gene ID: 871

Organism: Homo sapiens

Other Aliases: PIG14, AsTP3, CBP1, CBP2, HSP47, OI10, PPROM, RA-A47, SERPINH2, gp46

Other Designations: 47 kDa heat shock protein; arsenic-transactivated protein 3; cell proliferation-inducing gene 14 protein; colligin-1; colligin-2; rheumatoid arthritis antigen A-47; rheumatoid arthritis-related antigen RA-A47; serine (or cysteine) proteinase inhibitor, clade H (heat shock protein 47), member 1, (collagen binding protein 1); serine (or cysteine) proteinase inhibitor, clade H (heat shock protein 47), member 2, (collagen-binding protein 2); serpin H1

Nucleotide sequence:

NCBI Reference Sequence: NM_001207014.1

LOCUS     NM_001207014

ACCESSION     NM_001207014

(SEQ ID NO: 33)

Protein sequence:

NCBI Reference Sequence: NP_001193943.1

LOCUS     NP_001193943

ACCESSION     NP_001193943

(SEQ ID NO: 34)

ITB1

Official Symbol: ITGB1

Official Name: integrin, beta 1 (fibronectin receptor, beta polypeptide, antigen CD29 includes MDF2, MSK12)

Gene ID: 3688

Organism: Homo sapiens

Other Aliases: RP11-479G22.2, CD29, FNRB, GPIIA, MDF2, MSK12, VLA-BETA, VLAB

Other Designations: integrin VLA-4 beta subunit; integrin beta-1; very late activation protein, beta polypeptide Nucleotide sequence:

NCBI Reference Sequence: NM_002211.3

LOCUS    NM_002211

ACCESSION  NM_002211

(SEQ ID NO: 35)

Protein sequence:

NCBI Reference Sequence: NP_002202.2

LOCUS    NP_002202

ACCESSION  NP_002202

(SEQ ID NO: 36)

FKB10

Official Symbol: FKBP10

Official Name: FK506 binding protein 10, 65 kDa

Gene ID: 60681

Organism: Homo sapiens

Other Aliases: PSEC0056, FKBP65, OI11, OI6, PPIASE, hFKBP65

Other Designations: 65 kDa FK506-binding protein; 65 kDa FKBP; FK506-binding protein 10; FKBP-10; FKBP-65; PPIase FKBP10; immunophilin FKBP65; peptidyl-prolyl cis-trans isomerase FKBP10; rotamase Nucleotide sequence:

NCBI Reference Sequence: NM_021939.3

LOCUS    NM_021939

ACCESSION  NM_021939

(SEQ ID NO: 37)

Protein sequence:

NCBI Reference Sequence: NP_068758.3

LOCUS    NP_068758

ACCESSION   NP_068758

(SEQ ID NO: 38)

FINC

Official Symbol: FN1

Official Name: fibronectin 1

Gene ID: 2335

Organism: Homo sapiens

Other Aliases: CIG, ED-B, FINC, FN, FNZ, GFND, GFND2, LETS, MSF

Other Designations: cold-insoluble globulin; fibronectin; migration-stimulating factor Nucleotide sequence:

NCBI Reference Sequence: NM_002026.2

LOCUS    NM_002026

ACCESSION   NM_002026

(SEQ ID NO: 39)

Protein sequence:

NCBI Reference Sequence: NP_002017.1

LOCUS    NP_002017

ACCESSION   NP_002017

(SEQ ID NO: 40)

CYB5

Official Symbol: CYB5A

Official Name: cytochrome b5 type A (microsomal)

Gene ID: 1528

Organism: Homo sapiens

Other Aliases: CYB5, MCB5

Other Designations: cytochrome b5; type 1 cyt-b5

Note – there are three difference isoforms

Isoform 1

Nucleotide sequence:

NCBI Reference Sequence: NM_148923.3

LOCUS    NM_148923

ACCESSION   NM_148923

(SEQ ID NO: 41)

Protein sequence:

NCBI Reference Sequence: NP_683725.1

LOCUS    NP_683725

ACCESSION   NP_683725

(SEQ ID NO: 42)

Isoform 2

Nucleotide sequence:

NCBI Reference Sequence: NM_001914.3

LOCUS    NM_001914

ACCESSION   NM_001914

(SEQ ID NO: 43)

Protein sequence:

NCBI Reference Sequence: NP_001905.1

LOCUS    NP_001905

ACCESSION  NP_001905

(SEQ ID NO: 44)

Isoform 3

Nucleotide sequence:

NCBI Reference Sequence: NM_001190807.2

LOCUS    NM_001190807

ACCESSION  NM_001190807

(SEQ ID NO: 45)

Protein sequence:

NCBI Reference Sequence: NP_001177736.1

LOCUS    NP_001177736

ACCESSION  NP_001177736

(SEQ ID NO: 46)

PAI1

Official Symbol: SERPINE1

Official Name: serpin peptidase inhibitor, clade E (nexin, plasminogen activator inhibitor type 1), member 1

Gene ID: 5054

Organism: Homo sapiens

Other Aliases: PAI, PAI-1, PAI1, PLANH1

Other Designations: endothelial plasminogen activator inhibitor; plasminogen activator inhibitor 1; serine (or cysteine) proteinase inhibitor, clade E (nexin, plasminogen activator inhibitor type 1), member 1; serpin E1

Nucleotide sequence (Isoform 1):

NCBI Reference Sequence: NM_000602.4

LOCUS    NM_000602

ACCESSION    NM_000602

(SEQ ID NO: 47)

Protein sequence (isoform 1):

NCBI Reference Sequence: NP_000593.1

LOCUS    NP_000593

ACCESSION    NP_000593

(SEQ ID NO: 48)

Nucleotide sequence (isoform 2):

NCBI Reference Sequence: NM_001165413.2

LOCUS    NM_001165413

ACCESSION    NM_001165413

(SEQ ID NO: 49)

Protein sequence (isoform 2):

NCBI Reference Sequence: NP_001158885.1

LOCUS    NP_001158885

ACCESSION    NP_001158885

(SEQ ID NO: 50)

MPR1

Official Symbol: IGF2R

Official Name: insulin-like growth factor 2 receptor

Gene ID: 3482

Organism: Homo sapiens

Other Aliases: CD222, CIMPR, M6P-R, MPR1, MPRI

Other Designations: 300 kDa mannose 6-phosphate receptor; CI Man-6-P receptor; CI-MPR; IGF-II receptor; M6P/IGF2 receptor; M6P/IGF2R; M6PR; MPR 300; cation-independent mannose-6 phosphate receptor; cation-independent mannose-6-phosphate receptor; insulin-like growth factor II receptor Nucleotide sequence:

NCBI Reference Sequence: NM_000876.2

LOCUS    NM_000876

ACCESSION  NM_000876

(SEQ ID NO: 51)

Protein sequence:

NCBI Reference Sequence: NP_000867.2

LOCUS    NP_000867

ACCESSION  NP_000867

(SEQ ID NO: 52)

1A69

Official Symbol: HLA-A

Official Name: major histocompatibility complex, class I, A

Gene ID: 3105

Organism: Homo sapiens

Other Aliases: DAQB-90C11.16-002, HLAA

Other Designations: HLA class I histocompatibility antigen, A-1 alpha chain; MHC class I antigen HLA-A heavy chain; antigen presenting molecule; leukocyte antigen class I-A Nucleotide sequence (variant 1):

NCBI Reference Sequence: NM_002116.7

LOCUS    NM_002116

ACCESSION  NM_002116

(SEQ ID NO: 53)

Protein sequence (variant 1):

NCBI Reference Sequence: NP_002107.3

LOCUS    NP_002107

ACCESSION  NP_002107

(SEQ ID NO: 54)

Nucleotide sequence (variant 2):

NCBI Reference Sequence: NM_001242758.1

LOCUS    NM_001242758

ACCESSION  NM_001242758

(SEQ ID NO: 55)

Protein sequence (variant 2):

NCBI Reference Sequence: NP_001229687.1

LOCUS    NP_001229687

ACCESSION  NP_001229687

(SEQ ID NO: 56)

P4HA2

Official Symbol: P4HA2

Official Name: prolyl 4-hydroxylase, alpha polypeptide II

Gene ID: 8974

Organism: Homo sapiens

Other Aliases: UNQ290/PRO330

Other Designations: 4-PH alpha 2; 4-PH alpha-2; C-P4Halpha(II); collagen prolyl 4-hydroxylase alpha(II); procollagen-proline, 2-oxoglutarate 4-dioxygenase (proline 4-hydroxylase), alpha polypeptide II; procollagen-proline,2-oxoglutarate-4-dioxygenase subunit alpha-2; prolyl 4-hydroxylase subunit alpha-2

Nucleotide sequence (variant 1):

NCBI Reference Sequence: NM_004199.2

LOCUS      NM_004199

ACCESSION  NM_004199

(SEQ ID NO: 57)

Protein sequence (variant 1):

NCBI Reference Sequence: NP_004190.1

LOCUS      NP_004190

ACCESSION  NP_004190

(SEQ ID NO: 58)

Nucleotide sequence (variant 2):

NCBI Reference Sequence: NM_001017973.1

LOCUS      NM_001017973

ACCESSION  NM_001017973

(SEQ ID NO: 59)

Protein sequence (variant 2):

NCBI Reference Sequence: NP_001017973.1

LOCUS    NP_001017973

ACCESSION  NP_001017973

(SEQ ID NO: 60)

Nucleotide sequence (variant 3):

NCBI Reference Sequence: NM_001017974.1

LOCUS    NM_001017974

ACCESSION   NM_001017974

(SEQ ID NO: 61)

Protein sequence (variant 3):

NCBI Reference Sequence: NP_001017974.1

LOCUS    NP_001017974

ACCESSION  NP_001017974

(SEQ ID NO: 62)

Nucleotide sequence (variant 4):

NCBI Reference Sequence: NM_001142598.1

LOCUS    NM_001142598

ACCESSION   NM_001142598

(SEQ ID NO: 63)

Protein sequence (variant 4):

NCBI Reference Sequence: NP_001136070.1

LOCUS    NP_001136070

ACCESSION  NP_001136070

(SEQ ID NO: 64)

Nucleotide sequence: (variant 5)

NCBI Reference Sequence: NM_001142599.1

LOCUS    NM_001142599

ACCESSION    NM_001142599

(SEQ ID NO: 65)

Protein sequence:

NCBI Reference Sequence: NP_001136071.1

LOCUS    NP_001136071

ACCESSION    NP_001136071

(SEQ ID NO: 66)

HNRPG

Official Symbol: RBMX

Official Name: RNA binding motif protein, X-linked

Gene ID: 27316

Organism: Homo sapiens

Other Aliases: RP11-1114A5.1, HNRPG, RBMXP1, RBMXRT, RNMX, hnRNP-G

Other Designations: RNA binding motif protein, X chromosome; RNA-binding motif protein, X chromosome; glycoprotein p43; heterogeneous nuclear ribonucleoprotein G; hnRNP G Nucleotide sequence (variant 1):

NCBI Reference Sequence: NM_002139.3

LOCUS    NM_002139

ACCESSION    NM_002139

(SEQ ID NO: 67)

Protein sequence (variant 1):

NCBI Reference Sequence: NP_002130.2

LOCUS    NP_002130

ACCESSION  NP_002130

(SEQ ID NO: 68)

Nucleotide sequence (variant 2):

NCBI Reference Sequence: NM_001164803.1

LOCUS    NM_001164803

ACCESSION  NM_001164803

(SEQ ID NO: 69)

Protein sequence (variant 2):

NCBI Reference Sequence: NP_001158275.1

LOCUS    NP_001158275

ACCESSION  NP_001158275

(SEQ ID NO: 70)

IBP7

Official Symbol: IGFBP7

Official Name: insulin-like growth factor binding protein 7

Gene ID: 3490

Organism: Homo sapiens

Other Aliases: AGM, FSTL2, IBP-7, IGFBP-7, IGFBP-7v, IGFBPRP1, MAC25, PSF, RAMSVPS, TAF Other Designations: IGF-binding protein 7; IGFBP-rP1; PGI2-stimulating factor; angiomodulin; insulin-like growth factor-binding protein 7; prostacyclin-stimulating factor; tumor-derived adhesion factor Nucleotide sequence (variant 1):

NCBI Reference Sequence: NM_001553.2

LOCUS    NM_001553

ACCESSION   NM_001553

(SEQ ID NO: 71)

Protein sequence (variant 1):

NCBI Reference Sequence: NP_001544.1

LOCUS    NP_001544

ACCESSION  NP_001544

(SEQ ID NO: 72)

Nucleotide sequence (variant 2)

NCBI Reference Sequence: NM_001253835.1

LOCUS    NM_001253835

ACCESSION   NM_001253835

(SEQ ID NO: 73)

Protein sequence (variant 2):

NCBI Reference Sequence: NP_001240764.1

LOCUS    NP_001240764

ACCESSION  NP_001240764

(SEQ ID NO: 74)

1C17

Official Symbol: HLA-C

Official Name: major histocompatibility complex, class I, C

Gene ID: 3107

Organism: Homo sapiens

Other Aliases: XXbac-BCX101P6.2, D6S204, HLA-JY3, HLC-C, PSORS1

Other Designations: HLA class I histocompatibility antigen, C alpha chain; HLA class I histocompatibility antigen, Cw-1 alpha chain; MHC class I antigen heavy chain HLA-C; human leukocyte antigen-C alpha chain; major histocompatibility antigen HLA-C

Nucleotide sequence (variant 1):

NCBI Reference Sequence: NM_002117.5

LOCUS     NM_002117

ACCESSION   NM_002117

1     (SEQ ID NO: 75)

Protein sequence (variant 1):

NCBI Reference Sequence: NP_002108.4

LOCUS    NP_002108

ACCESSION   NP_002108

(SEQ ID NO: 76)

Nucleotide sequence (variant 2):

NCBI Reference Sequence: NM_001243042.1

LOCUS     NM_001243042

ACCESSION   NM_001243042

(SEQ ID NO: 77)

Protein sequence (variant 2):

NCBI Reference Sequence: NP_001229971.1

LOCUS    NP_001229971

ACCESSION NP_001229971

(SEQ ID NO: 78)

RRAS2

Official Symbol: RRAS2

Official Name: related RAS viral (r-ras) oncogene homolog 2

Gene ID: 22800

Organism: Homo sapiens

Other Aliases: TC21

Other Designations: ras-like protein TC21; ras-related protein R-Ras2; teratocarcinoma oncogene Nucleotide sequence (variant 1):

NCBI Reference Sequence: NM_012250.5

LOCUS    NM_012250

ACCESSION  NM_012250

(SEQ ID NO: 79)

Protein sequence (variant 1):

NCBI Reference Sequence: NP_036382.2

LOCUS    NP_036382

ACCESSION  NP_036382

(SEQ ID NO: 80)

Nucleotide sequence (variant 2):

NCBI Reference Sequence: NM_001102669.2

LOCUS    NM_001102669

ACCESSION  NM_001102669

(SEQ ID NO: 81)

Protein sequence (varaiant 2):

NCBI Reference Sequence: NP_001096139.1

LOCUS   NP_001096139

ACCESSION NP_001096139

(SEQ ID NO: 82)

Nucleotide sequence (variant 3):

NCBI Reference Sequence: NM_001177314.1

LOCUS   NM_001177314

ACCESSION NM_001177314

(SEQ ID NO: 83)

//

Protein sequence (variant 3):

NCBI Reference Sequence: NP_001170785.1

LOCUS   NP_001170785

ACCESSION NP_001170785

1 msyfvtdydp tiedsytkqc viddraarld ildtagqeef gamreqymrt gegfllvfsv
61 tdrgsfeeiy kfqrqilrvk drdefpmili gnkadldhqr qvtqeegqql arqlkvtyme
121 asakirmnvd qafhelvrvi rkfqeqecpp speptrkekd kkgchcvif (SEQ ID NO: 84)

Nucleotide sequence (variant 4):

NCBI Reference Sequence : NM_001177315.1

LOCUS   NM_001177315

ACCESSION NM_001177315

(SEQ ID NO: 85)

Protein sequence (variant 4):

NCBI Reference Sequence: NP_001170786.1

LOCUS    NP_001170786

ACCESSION NP_001170786

(SEQ ID NO: 86)

TSP1

Official Symbol: THBS1

Official Name: thrombospondin 1

Gene ID: 7057

Organism: Homo sapiens

Other Aliases: THBS, THBS-1, TSP, TSP-1, TSP1

Other Designations: thrombospondin-1; thrombospondin-1p180

Nucleotide sequence:

NCBI Reference Sequence: NM_003246.2

LOCUS    NM_003246

ACCESSION   NM_003246

(SEQ ID NO: 87)

Protein sequence:

NCBI Reference Sequence: NP_003237.2

LOCUS    NP_003237

ACCESSION NP_003237

(SEQ ID NO: 88)

EDIL3

Official Symbol: EDIL3

Official Name: EGF-like repeats and discoidin I-like domains 3

Gene ID: 10085

Organism: Homo sapiens

Other Aliases: DEL1

Other Designations: EGF-like repeat and discoidin I-like domain-containing protein 3; developmental endothelial locus-1; developmentally-regulated endothelial cell locus 1 protein; integrin-binding protein DEL1

Nucleotide sequence:

NCBI Reference Sequence: NM_005711.3

LOCUS       NM_005711

ACCESSION   NM_005711

(SEQ ID NO: 89)

Protein sequence:

NCBI Reference Sequence: NP_005702.3

LOCUS       NP_005702

ACCESSION   NP_005702

(SEQ ID NO: 90)

HMOX1

Official Symbol: HMOX1

Official Name: heme oxygenase (decycling) 1

Gene ID: 3162

Organism: Homo sapiens

Other Aliases: CTA-286B10.6, HO-1, HSP32, bK286B10

Other Designations: heat shock protein, 32-kD; heme oxygenase 1

Nucleotide sequence:

NCBI Reference Sequence: NM_002133.2

LOCUS    NM_002133

ACCESSION   NM_002133

(SEQ ID NO: 91)

Protein sequence:

NCBI Reference Sequence: NP_002124.1

LOCUS    NP_002124

ACCESSION   NP_002124

(SEQ ID NO: 92)

NUCB1

Official Symbol: NUCB1

Official Name: nucleobindin 1

Gene ID: 4924

Organism: Homo sapiens

Other Aliases: CALNUC, NUC

Other Designations: nucleobindin-1

Nucleotide sequence:

NCBI Reference Sequence: NM_006184.5

LOCUS    NM_006184

ACCESSION   NM_006184

(SEQ ID NO: 93)

Protein sequence:

NCBI Reference Sequence: NP_006175.2

LOCUS    NP_006175

ACCESSION   NP_006175

(SEQ ID NO: 94)

CS010

Official Symbol: C19orf10

Official Name: chromosome 19 open reading frame 10

Gene ID: 56005

Organism: Homo sapiens

Other Aliases: EUROIMAGE1875335, IL25, IL27, IL27w, R33729_1, SF20

Other Designations: UPF0556 protein C19orf10; interleukin 25; interleukin 27 working designation; interleukin-25; stromal cell-derived growth factor SF20

Nucleotide sequence:

NCBI Reference Sequence: NM_019107.3

LOCUS    NM_019107

ACCESSION   NM_019107

(SEQ ID NO: 95)

Protein sequence:

NCBI Reference Sequence: NP_061980.1

LOCUS    NP_061980

ACCESSION  NP_061980

(SEQ ID NO: 96)

PLIN2

Official Symbol: PLIN2

Official Name: perilipin 2

Gene ID: 123

Organism: Homo sapiens

Other Aliases: RP11-151J10.1, ADFP, ADRP

Other Designations: adipophilin; adipose differentiation-related protein; perilipin-2

Nucleotide sequence:

NCBI Reference Sequence: NM_001122.3

LOCUS    NM_001122

ACCESSION   NM_001122

(SEQ ID NO: 97)

Protein sequence:

NCBI Reference Sequence: NP_001113.2

LOCUS    NP_001113

ACCESSION   NP_001113.2

(SEQ ID NO: 98)

ATP5A

Official Symbol: ATP5A1

Official Name: ATP synthase, H+ transporting, mitochondrial F1 complex, alpha subunit 1, cardiac muscle Gene ID: 498

Organism: Homo sapiens

Other Aliases: ATP5A, ATP5AL2, ATPM, MOM2, OMR, ORM, hATP1

Other Designations: ATP synthase alpha chain, mitochondrial; ATP synthase subunit alpha, mitochondrial; ATP synthase, H+ transporting, mitochondrial F1 complex, alpha subunit, isoform 1, cardiac muscle; ATP synthase, H+ transporting, mitochondrial F1 complex, alpha subunit, isoform 2, non-cardiac muscle-like 2; ATP sythase (F1-ATPase) alpha subunit; mitochondrial ATP synthetase, oligomycin-resistant Nucleotide sequence (variant 1):

NCBI Reference Sequence: NM_001001937.1

LOCUS    NM_001001937

ACCESSION   NM_001001937

(SEQ ID NO: 99)

Protein sequence (variant 1):

NCBI Reference Sequence: NP_001001937.1

LOCUS    NP_001001937

ACCESSION   NP_001001937

(SEQ ID NO: 100)

Nucleotide sequence (variant 2):

NCBI Reference Sequence: NM_004046.5

LOCUS    NM_004046

ACCESSION   NM_004046

(SEQ ID NO: 101)

Protein sequence (variant 2):

NCBI Reference Sequence: NP_004037.1

LOCUS    NP_004037

ACCESSION   NP_004037

(SEQ ID NO: 102)

Nucleotide sequence (variant 3):

NCBI Reference Sequence: NM_001257334.1

LOCUS    NM_001257334

ACCESSION   NM_001257334

(SEQ ID NO: 103)

Protein sequence (variant 3):

NCBI Reference Sequence: NP_001244263.1

LOCUS    NP_001244263

ACCESSION   NP_001244263

(SEQ ID NO: 104)

Nucleotide sequence (variant 4):

NCBI Reference Sequence: NM_001001935.2

LOCUS    NM_001001935

ACCESSION   NM_001001935

(SEQ ID NO: 105)

Protein sequence (variant 4):

NCBI Reference Sequence: NP_001001935.1

LOCUS    NP_001001935

ACCESSION   NP_001001935.1

(SEQ ID NO: 106)

Nucleotide sequence (variant 5):

NCBI Reference Sequence: NM_001257335.1

LOCUS    NM_001257335

ACCESSION   NM_001257335

(SEQ ID NO: 107)

Protein sequence (variant 5):

NCBI Reference Sequence: NP_001244264.1

LOCUS    NP_001244264

ACCESSION  NP_001244264

(SEQ ID NO: 108)

HSPA9

(See entry for GRP75 above)

MARS

Official Symbol: MARS

Official Name: methionyl-tRNA synthetase

Gene ID: 4141

Organism: Homo sapiens

Other Aliases: METRS, MRS, MTRNS

Other Designations: cytosolic methionyl-tRNA synthetase; methionine tRNA ligase 1, cytoplasmic; methionine--tRNA ligase, cytoplasmic Nucleotide sequence:

NCBI Reference Sequence: NM_004990.3

LOCUS    NM_004990

ACCESSION  NM_004990

(SEQ ID NO: 109)

Protein sequence:

NCBI Reference Sequence: NP_004981.2

LOCUS    NP_004981

ACCESSION  NP_004981

(SEQ ID NO: 110)

SENP1

Official Symbol: SENP1

Official Name: SUMO1/sentrin specific peptidase 1

Gene ID: 29843

Organism: Homo sapiens

Other Aliases: SuPr-2

Other Designations: SUMO1/sentrin specific protease 1; sentrin-specific protease 1; sentrin/SUMO-specific protease SENP1

Nucleotide sequence (variant 1):

NCBI Reference Sequence: NM_001267594.1

LOCUS    NM_001267594

ACCESSION    NM_001267594

(SEQ ID NO: 111)

Protein sequence (variant 1):

NCBI Reference Sequence: NP_001254523.1

LOCUS    NP_001254523

ACCESSION    NP_001254523

(SEQ ID NO: 112)

Nucleotide sequence (variant 2):

NCBI Reference Sequence: NM_001267595.1

LOCUS    NM_001267595

ACCESSION    NM_001267595

(SEQ ID NO: 113)

Protein sequence (variant 2):

NCBI Reference Sequence: NP_001254524.1

LOCUS    NP_001254524

ACCESSION   NP_001254524

(SEQ ID NO: 114)

ATPIF1

Official Symbol: ATPIF1

Official Name: ATPase inhibitory factor 1

Gene ID: 93974

Organism: Homo sapiens

Other Aliases: RP5-1092A3.1, ATPI, ATPIP, IP

Other Designations: ATP synthase inhibitor protein; ATPase inhibitor protein; ATPase inhibitor, mitochondrial; IF(1); IF1; inhibitor of F(1)F(o)-ATPase Nucleotide sequence (variant 1):

NCBI Reference Sequence: NM_016311.4

LOCUS    NM_016311

ACCESSION   NM_016311

(SEQ ID NO: 115)

Protein sequence (variant 1):

NCBI Reference Sequence: NP_057395.1

LOCUS   NP_057395

ACCESSION   NP_057395

1 mavtalaart wlgvwgvrtm qargfgsdqs envdrgagsi reaggafgkr eqaeeeryfr
61 aqsreqlaal kkhheeeivh hkkeierlqk eierhkqkik mlkhdd (SEQ ID NO: 116)

Nucleotide sequence (variant 2):

NCBI Reference Sequence: NM_178190.2

LOCUS    NM_178190

ACCESSION    NM_178190

(SEQ ID NO: 117)

Protein sequence (variant 2):

NCBI Reference Sequence: NP_835497.1

LOCUS    NP_835497

ACCESSION    NP_835497

1 mavtalaart wlgvwgvrtm qargfgsdqs envdrgagsi reaggafgkr eqaeeeryfr
61 hyrlcfeisl g (SEQ ID NO: 118)

Nucleotide sequence (variant 3)

NCBI Reference Sequence: NM_178191.2

LOCUS    NM_178191

ACCESSION    NM_178191

(SEQ ID NO: 119)

Protein sequence (variant 3):

NCBI Reference Sequence: NP_835498.1

LOCUS    NP_835498

ACCESSION    NP_835498

(SEQ ID NO: 120)

VAMP3

Official Symbol: VAMP3

Official Name: vesicle-associated membrane protein 3 (cellubrevin)

Gene ID: 9341

Organism: Homo sapiens

Other Aliases: CEB

Other Designations: VAMP-3; cellubrevin; synaptobrevin-3; vesicle-associated membrane protein 3

Nucleotide sequence:

NCBI Reference Sequence: NM_004781.3

LOCUS    NM_004781

ACCESSION NM_004781

(SEQ ID NO: 121)

Protein sequence:

NCBI Reference Sequence: NP_004772.1

LOCUS    NP_004772

ACCESSION    NP_004772

(SEQ ID NO: 122)

VAPA

Official Symbol: VAPA

Official Name: VAMP (vesicle-associated membrane protein)-associated protein A, 33kDa Gene ID: 9218

Organism: Homo sapiens

Other Aliases: VAP-33, VAP-A, VAP33, hVAP-33

Other Designations: 33 kDa VAMP-associated protein; VAMP-A; VAMP-associated protein A; vesicle-associated membrane protein-associated protein A Nucleotide sequence (variant 1):

NCBI Reference Sequence: NM_003574.5

LOCUS    NM_003574

ACCESSION    NM_003574

(SEQ ID NO: 123)

Protein sequence (variant 1):

NCBI Reference Sequence: NP_003565.4

LOCUS    NP_003565

ACCESSION    NP_003565

(SEQ ID NO: 124)

Nucleotide sequence (variant 2):

NCBI Reference Sequence: NM_194434.2

LOCUS    NM_194434

ACCESSION    NM_194434

(SEQ ID NO: 125)

Protein sequence (variant 2):

NCBI Reference Sequence: NP_919415.2

LOCUS    NP_919415

ACCESSION    NP_919415

(SEQ ID NO: 126)

HNRNPD

Official Symbol: HNRNPD

Official Name: heterogeneous nuclear ribonucleoprotein D (AU-rich element RNA binding protein 1, 37kDa Gene ID: 3184

Organism: Homo sapiens

Other Aliases: AUF1, AUF1A, HNRPD, P37, hnRNPD0

Other Designations: ARE-binding protein AUFI, type A; heterogeneous nuclear ribonucleoprotein D0; hnRNP D0

Nucleotide sequence (variant 1):

NCBI Reference Sequence: NM_031370.2

LOCUS    NM_031370

ACCESSION    NM_031370

(SEQ ID NO: 127)

Protein sequence (variant 1):

NCBI Reference Sequence: NP_112738.1

LOCUS    NP_112738

ACCESSION    NP_112738

(SEQ ID NO: 128)

Nucleotide sequence (variant 2):

NCBI Reference Sequence: NM_031369.2

LOCUS    NM_031369

ACCESSION    NM_031369

(SEQ ID NO: 129)

Protein sequence (variant 2):

NCBI Reference Sequence: NP_112737.1

LOCUS    NP_112737

ACCESSION    NP_112737

(SEQ ID NO: 130)

Nucleotide sequence (variant 3):

NCBI Reference Sequence: NM_002138.3

LOCUS    NM_002138

ACCESSION    NM_002138

(SEQ ID NO: 131)

Protein sequence (variant 3):

NCBI Reference Sequence: NP_002129.2

LOCUS    NP_002129

ACCESSION  NP_002129

(SEQ ID NO: 132)

Nucleotide sequence (variant 4):

NCBI Reference Sequence: NM_001003810.1

LOCUS    NM_001003810

ACCESSION  NM_001003810

(SEQ ID NO: 133)

Protein sequence (variant 4):

NCBI Reference Sequence: NP_001003810.1

LOCUS    NP_001003810

ACCESSION  NP_001003810

(SEQ ID NO: 134)

BSG

Official Symbol: BSG

Official Name: basigin (Ok blood group)

Gene ID: basigin (Ok blood group)

Organism: Homo sapiens

Other Aliases: UNQ6505/PRO21383, 5F7, CD147, EMMPRIN, M6, OK, TCSF

Other Designations: CD147 antigen; OK blood group antigen; basigin; collagenase stimulatory factor; extracellular matrix metalloproteinase inducer; leukocyte activation antigen M6; tumor cell-derived collagenase stimulatory factor Nucleotide sequence (variant 1):

NCBI Reference Sequence: NM_001728.3

LOCUS    NM_001728

ACCESSION   NM_001728

(SEQ ID NO: 135)

Protein sequence (variant 1):

NCBI Reference Sequence: NP_001719.2

LOCUS    NP_001719

ACCESSION   NP_001719

(SEQ ID NO: 136)

Nucleotide sequence (variant 2):

NCBI Reference Sequence: NM_198589.2

LOCUS    NM_198589

ACCESSION   NM_198589

(SEQ ID NO: 137)

Protein sequence (variant 2):

NCBI Reference Sequence: NP_940991.1

LOCUS    NP_940991

ACCESSION   NP_940991

(SEQ ID NO: 138)

Nucleotide sequence (variant 3):

NCBI Reference Sequence: NM_198590.2

LOCUS  NM_198590

ACCESSION  NM_198590

(SEQ ID NO: 139)

Protein sequence (variant 3):

NCBI Reference Sequence: NP_940992.1

LOCUS  NP_940992

ACCESSION  NP_940992

(SEQ ID NO: 140)

Nucleotide sequence (variant 4):

NCBI Reference Sequence: NM_198591.2

LOCUS  NM_198591

ACCESSION  NM_198591

(SEQ ID NO: 141)

Protein sequence (variant 4):

NCBI Reference Sequence: NP_940993.1

LOCUS  NP_940993

ACCESSION  NP_940993

(SEQ ID NO: 142)

EIF4A3

Official Symbol: EIF4A3

Official Name: eukaryotic translation initiation factor 4A3

Gene ID: 9775

Organism: Homo sapiens

Other Aliases: DDX48, NMP265, NUK34, eIF4AIII

Other Designations: ATP-dependent RNA helicase DDX48; ATP-dependent RNA helicase eIF4A-3; DEAD (Asp-Glu-Ala-Asp) (SEQ ID NO: 429) box polypeptide 48; DEAD (SEQ ID NO: 429) box protein 48; NMP 265; eIF-4A-III; eIF4A-III; eukaryotic initiation factor 4A-III; eukaryotic initiation factor 4A-like NUK-34; eukaryotic translation initiation factor 4A; hNMP 265; nuclear matrix protein 265

Nucleotide sequence:

NCBI Reference Sequence: NM_014740.3

LOCUS    NM_014740

ACCESSION    NM_014740

(SEQ ID NO: 143)

Protein sequence:

NCBI Reference Sequence: NP_055555.1

LOCUS    NP_055555

ACCESSION    NP_055555

(SEQ ID NO: 144)

MTHFD1

Official Symbol: MTHFD1

Official Name: methylenetetrahydrofolate dehydrogenase (NADP+ dependent) 1, methenyltetrahydrofolate cyclohydrolase, formyltetrahydrofolate synthetase Gene ID: 4522

Organism: Homo sapiens

Other Aliases: MTHFC, MTHFD

Other Designations: 5,10-methylenetetrahydrofolate dehydrogenase, 5,10-methylenetetrahydrofolate cyclohydrolase, 10-formyltetrahydrofolate synthetase; C-1-tetrahydrofolate synthase, cytoplasmic; C1-THF synthase; cytoplasmic C-1-tetrahydrofolate synthase Nucleotide sequence:

NCBI Reference Sequence: NM_005956.3

LOCUS    NM_005956

ACCESSION  NM_005956

(SEQ ID NO: 145)

Protein sequence:

NCBI Reference Sequence: NP_005947.3

LOCUS    NP_005947

ACCESSION  NP_005947

(SEQ ID NO: 146)

ENO2

Official Symbol: ENO2

Official Name: enolase 2 (gamma, neuronal)

Gene ID: 2026

Organism: Homo sapiens

Other Aliases: NSE

Other Designations: 2-phospho-D-glycerate hydro-lyase; 2-phospho-D-glycerate hydrolyase; gamma-enolase; neural enolase; neuron specific gamma enolase; neuron-specific enolase; neurone-specific enolase Nucleotide sequence:

NCBI Reference Sequence: NM_001975.2

LOCUS    NM_001975

ACCESSION  NM_001975

(SEQ ID NO: 147)

Protein sequence:

NCBI Reference Sequence: NP_001966.1

LOCUS    NP_001966

ACCESSION   NP_001966

(SEQ ID NO: 148)

ATP5H

Official Symbol: ATP5H

Official Name: ATP synthase, H+ transporting, mitochondrial Fo complex, subunit d Gene ID: 10476

Organism: Homo sapiens

Other Aliases: My032, ATPQ

Other Designations: ATP synthase D chain, mitochondrial; ATP synthase subunit d, mitochondrial; ATP synthase, H+ transporting, mitochondrial F0 complex, subunit d; ATP synthase, H+ transporting, mitochondrial F1F0, subunit d; ATPase subunit d; My032 protein Nucleotide sequence (variant 1):

NCBI Reference Sequence: NM_006356.2

LOCUS    NM_006356

ACCESSION   NM_006356.

(SEQ ID NO: 149)

Protein sequence (variant 1):

NCBI Reference Sequence: NP_006347.1

LOCUS    NP_006347

ACCESSION   NP_006347

(SEQ ID NO: 150)

Nucleotide sequence (variant 2):

NCBI Reference Sequence: NM_001003785.1

LOCUS     NM_001003785

ACCESSION   NM_001003785

(SEQ ID NO: 151)

Protein sequence (variant 2):

NCBI Reference Sequence: NP_001003785.1

LOCUS    NP_001003785

ACCESSION   NP_001003785

(SEQ ID NO: 152)

TRAP1

Official Symbol: TRAP1

Official Name: TNF receptor-associated protein 1

Gene ID: 10131

Organism: Homo sapiens

Other Aliases: HSP75, HSP90L

Other Designations: HSP 75; TNFR-associated protein 1; TRAP-1; heat shock protein 75 kDa, mitochondrial; tumor necrosis factor type 1 receptor associated protein; tumor necrosis factor type 1 receptor-associated protein Nucleotide sequence:

NCBI Reference Sequence: NM_016292.2

LOCUS     NM_016292

ACCESSION   NM_016292

(SEQ ID NO: 153)

Protein sequence:

NCBI Reference Sequence: NP_057376.2

LOCUS    NP_057376

ACCESSION   NP_057376

(SEQ ID NO: 154)

SDHA

Official Symbol: SDHA

Official Name: succinate dehydrogenase complex, subunit A, flavoprotein (Fp)

Gene ID: 6389

Organism: Homo sapiens

Other Aliases: CMD1GG, FP, PGL5, SDH1, SDH2, SDHF

Other Designations: flavoprotein subunit of complex II; succinate dehydrogenase [ubiquinone] flavoprotein subunit, mitochondrial; succinate dehydrogenase complex flavoprotein subunit Nucleotide sequence:

NCBI Reference Sequence: NM_004168.2

LOCUS    NM_004168

ACCESSION   NM_004168

(SEQ ID NO: 155)

Protein sequence:

NCBI Reference Sequence: NP_004159.2

LOCUS    NP_004159

ACCESSION NP_004159

(SEQ ID NO: 156)

TPMA

Official Symbol: TPM4

Official Name: tropomyosin 4

Gene ID: 7171

Organism: Homo sapiens

Other Aliases:

Other Designations: TM30p1; tropomyosin alpha-4 chain; tropomyosin-4;

Nucleotide sequence (variant 1):

NCBI Reference Sequence: NM_001145160.1

LOCUS    NM_001145160

ACCESSION   NM_001145160

(SEQ ID NO: 157)

Protein sequence (variant 1):

NCBI Reference Sequence: NP_001138632.1

LOCUS    NP_001138632

ACCESSION   NP_001138632

(SEQ ID NO: 158)

Nucleotide sequence:

NCBI Reference Sequence (variant 2): NM_003290.2

LOCUS    NM_003290

ACCESSION   NM_003290

(SEQ ID NO: 159)

Protein sequence (variant 2):

NCBI Reference Sequence: NP_003281.1

LOCUS    NP_003281

ACCESSION   NP_003281

(SEQ ID NO: 160)

ETFA

Official Symbol: ETFA

Official Name: electron-transfer-flavoprotein, alpha polypeptide

Gene ID: 2108

Organism: Homo sapiens

Other Aliases: EMA, GA2, MADD

Other Designations: alpha-ETF; electron transfer flavoprotein alpha-subunit; electron transfer flavoprotein subunit alpha, mitochondrial; electron transfer flavoprotein, alpha polypeptide; glutaric aciduria II Nucleotide sequence (variant 1):

NCBI Reference Sequence: NM_000126.3

LOCUS    NM_000126

ACCESSION   NM_000126

(SEQ ID NO: 161)

Protein sequence (variant 1):

NCBI Reference Sequence: NP_000117.1

LOCUS    NP_000117

ACCESSION   NP_000117

(SEQ ID NO: 162)

Nucleotide sequence (variant 2):

NCBI Reference Sequence: NM_001127716.1

LOCUS    NM_001127716

ACCESSION   NM_001127716

(SEQ ID NO: 163)

Protein sequence (variant 2):

NCBI Reference Sequence: NP_001121188.1

LOCUS    NP_001121188

ACCESSION   NP_001121188

(SEQ ID NO: 164)

RPL8

Official Symbol: RPL8

Official Name: ribosomal protein L8

Gene ID: 6132

Organism: Homo sapiens

Other Aliases: L8

Other Designations: 60S ribosomal protein L8

Nucleotide sequence (variant 1):

NCBI Reference Sequence : NM_000973.3

LOCUS    NM_000973

ACCESSION   NM_000973

(SEQ ID NO: 165)

Protein sequence (variant 1):

NCBI Reference Sequence: NP_000964.1

LOCUS    NP_000964

ACCESSION   NP_000964

(SEQ ID NO: 166)

Nucleotide sequence (variant 2):

NCBI Reference Sequence: NM_033301.1

LOCUS    NM_033301

ACCESSION   NM_033301

(SEQ ID NO: 167)

Protein sequence (variant 2):

NCBI Reference Sequence: NP_150644.1

LOCUS    NP_150644

ACCESSION   NP_150644

(SEQ ID NO: 168)

ARCN1

Official Symbol: ARCN1

Official Name: archain 1

Gene ID: 372

Organism: Homo sapiens

Other Aliases: COPD

Other Designations: archain vesicle transport protein 1; coatomer delta subunit; coatomer protein complex, subunit delta; coatomer protein delta-COP; coatomer subunit delta; delta-COP; delta-coat protein Nucleotide sequence (variant 1):

NCBI Reference Sequence: NM_001655.4

LOCUS  NM_001655

ACCESSION  NM_001655

(SEQ ID NO: 169)

Protein sequence (variant 1):

NCBI Reference Sequence: NP_001646.2

LOCUS  NP_001646

ACCESSION  NP_001646

(SEQ ID NO: 170)

Nucleotide sequence (variant 2):

NCBI Reference Sequence: NM_001142281.1

LOCUS  NM_001142281

ACCESSION  NM_001142281

(SEQ ID NO: 171)

Protein sequence (variant 2):

NCBI Reference Sequence: NP_001135753.1

LOCUS  NP_001135753

ACCESSION  NP_001135753

(SEQ ID NO: 172)

DDX18

Official Symbol: DDX18

Official Name: DEAD (Asp-Glu-Ala-Asp) (SEQ ID NO: 429) box polypeptide 18

Gene ID: 8886

Organism: Homo sapiens

Other Aliases: MrDb

Other Designations: ATP-dependent RNA helicase DDX18; DEAD (SEQ ID NO: 429) box protein 18; DEAD/H (Asp-Glu-Ala-Asp/His) box polypeptide 18 (Myc-regulated); Myc-regulated DEAD (SEQ ID NO: 429) box protein Nucleotide sequence:

NCBI Reference Sequence: NM_006773.3

LOCUS    NM_006773

ACCESSION    NM_006773

(SEQ ID NO: 173)

Protein sequence:

NCBI Reference Sequence: NP_006764.3

LOCUS    NP_006764

ACCESSION    NP_006764

(SEQ ID NO: 174)

G3BP2

Official Symbol: G3BP2

Official Name: GTPase activating protein (SH3 domain) binding protein 2

Gene ID: GTPase activating protein (SH3 domain) binding protein 2

Organism: Homo sapiens

Other Aliases:

Other Designations: G3BP-2; GAP SH3 domain-binding protein 2; Ras-GTPase activating protein SH3 domain-binding protein 2; ras GTPase-activating protein-binding protein 2

Nucleotide sequence (variant 1):

> NCBI Reference Sequence: NM_203505.2
>
> LOCUS    NM_203505
>
> ACCESSION   NM_203505
>
> (SEQ ID NO: 175)

Protein sequence (variant 1):

NCBI Reference Sequence: NP_987101.1

LOCUS    NP_987101

ACCESSION   NP_987101

(SEQ ID NO: 176)

Nucleotide sequence (variant 2):

> NCBI Reference Sequence: NM_012297.4
>
> LOCUS    NM_012297
>
> ACCESSION   NM_012297
>
> (SEQ ID NO: 177)

Protein sequence (variant 2):

NCBI Reference Sequence: NP_036429.2

LOCUS    NP_036429

ACCESSION   NP_036429

(SEQ ID NO: 178)

Nucleotide sequence (variant 3):

> NCBI Reference Sequence: NM_203504.2

LOCUS NM_203504

ACCESSION NM_203504

(SEQ ID NO: 179)

Protein sequence (variant 3):

NCBI Reference Sequence: NP_987100.1

LOCUS NP_987100

ACCESSION NP_987100

(SEQ ID NO: 180)

UQCRH

Official Symbol: UQCRH

Official Name: ubiquinol-cytochrome c reductase hinge protein

Gene ID: 7388

Organism: Homo sapiens

Other Aliases: QCR6, UQCR8

Other Designations: complex III subunit 6; complex III subunit VIII; cytochrome b-c1 complex subunit 6, mitochondrial; cytochrome c1 non-heme 11 kDa protein; mitochondrial hinge protein; ubiquinol-cytochrome c reductase complex 11 kDa protein; ubiquinol-cytochrome c reductase, complex III subunit VIII Nucleotide sequence:

NCBI Reference Sequence: NM_006004.2

LOCUS NM_006004

ACCESSION NM_006004

(SEQ ID NO: 181)

Protein sequence:

NCBI Reference Sequence: NP_005995.2

LOCUS    NP_005995

ACCESSION   NP_005995

(SEQ ID NO: 182)

HSPA4

Official Symbol: HSPA4

Official Name: heat shock 70kDa protein 4

Gene ID: 3308

Organism: Homo sapiens

Other Aliases: APG-2, HS24/P52, HSPH2, RY, hsp70, hsp70RY

Other Designations: heat shock 70 kDa protein 4; heat shock 70-related protein APG-2; heat shock 70kD protein 4; heat shock protein, 110 kDa; hsp70 RY Nucleotide sequence:

NCBI Reference Sequence: NM_002154.3

LOCUS    NM_002154

ACCESSION   NM_002154

(SEQ ID NO: 183)

Protein sequence:

NCBI Reference Sequence: NP_002145.3

LOCUS    NP_002145

ACCESSION   NP_002145

(SEQ ID NO: 184)

PSMA7

Official Symbol: PSMA7

Official Name: proteasome (prosome, macropain) subunit, alpha type, 7

Gene ID: 5688

Organism: Homo sapiens

Other Aliases: RP5-1005F21.4, C6, HSPC, RC6-1, XAPC7

Other Designations: proteasome subunit RC6-1; proteasome subunit XAPC7; proteasome subunit alpha 4; proteasome subunit alpha type-7

Nucleotide sequence:

NCBI Reference Sequence: NM_002792.3

LOCUS    NM_002792

ACCESSION    NM_002792

(SEQ ID NO: 185)

Protein sequence:

NCBI Reference Sequence: NP_002783.1

LOCUS    NP_002783

ACCESSION    NP_002783

(SEQ ID NO: 186)

KIF5B

Official Symbol: KIF5B

Official Name: kinesin family member 5B

Gene ID: 3799

Organism: Homo sapiens

Other Aliases: KINH, KNS, KNS1, UKHC

Other Designations: conventional kinesin heavy chain; kinesin 1 (110-120kD); kinesin heavy chain; kinesin-1 heavy chain; ubiquitous kinesin heavy chain Nucleotide sequence:

NCBI Reference Sequence: NM_004521.2

LOCUS    NM_004521

ACCESSION   NM_004521

(SEQ ID NO: 187)

Protein sequence:

NCBI Reference Sequence: NP_004512.1

LOCUS   NP_004512

ACCESSION   NP_004512

(SEQ ID NO: 188)

RPS25

Official Symbol: RPS25

Official Name: ribosomal protein S25

Gene ID: 6230

Organism: Homo sapiens

Other Aliases: S25

Other Designations: 40S ribosomal protein S25

Nucleotide sequence:

NCBI Reference Sequence: NM_001028.2

LOCUS    NM_001028

ACCESSION   NM_001028

(SEQ ID NO: 189)

Protein sequence:

NCBI Reference Sequence: NP_001019.1

LOCUS    NP_001019

ACCESSION   NP_001019

(SEQ ID NO: 190)

HSP90AB1

Official Symbol: HSP90AB1

Official Name: heat shock protein 90kDa alpha (cytosolic), class B member 1

Gene ID: 3326

Organism: Homo sapiens

Other Aliases: RP1-302G2.1, D6S182, HSP84, HSP90-BETA, HSP90B, HSPC2, HSPCB

Other Designations: 90-kda heat shock protein beta HSP90 beta; heat shock 84 kDa; heat shock 90kD protein 1, beta; heat shock 90kDa protein 1, beta; heat shock protein HSP 90-beta; heat shock protein beta Nucleotide sequence:

NCBI Reference Sequence: NM_007355.2

LOCUS    NM_007355

ACCESSION   NM_007355

(SEQ ID NO: 191)

Protein sequence:

NCBI Reference Sequence: NP_031381.2

LOCUS    NP_031381

ACCESSION   NP_031381

(SEQ ID NO: 192)

LMO7

Official Symbol: LMO7

Official Name: LIM domain 7

Gene ID: 4008

Organism: Homo sapiens

Other Aliases: RP11-332E3.2, FBX20, FBXO20, LOMP

Other Designations: F-box only protein 20; F-box protein Fbx20; LIM domain only 7 protein; LIM domain only protein 7; LMO-7; zinc-finger domain-containing protein Nucleotide sequence (variant 1):

NCBI Reference Sequence: NM_005358.5

LOCUS NM_005358

ACCESSION NM_005358

(SEQ ID NO: 193)

Protein sequence (variant 1):

NCBI Reference Sequence: NP_005349.3

LOCUS NP_005349

ACCESSION NP_005349

(SEQ ID NO: 194)

Nucleotide sequence (variant 2):

NCBI Reference Sequence: NM_015842.2

LOCUS NM_015842

ACCESSION NM_015842

(SEQ ID NO: 195)

Protein sequence (variant 2):

NCBI Reference Sequence: NP_056667.2

LOCUS    NP_056667

ACCESSION  NP_056667

(SEQ ID NO: 196)

CARS

Official Symbol: CARS

Official Name: cysteinyl-tRNA synthetase

Gene ID: 833

Organism: Homo sapiens

Other Aliases: CARS1, CYSRS, MGC:11246

Other Designations: cysteine tRNA ligase 1, cytoplasmic; cysteine translase; cysteine--tRNA ligase, cytoplasmic Nucleotide sequence (variant 1):

NCBI Reference Sequence: NM_139273.3

LOCUS    NM_139273

ACCESSION  NM_139273

(SEQ ID NO: 197)

Protein sequence (variant 1):

NCBI Reference Sequence: NP_644802.1

LOCUS    NP_644802

ACCESSION  NP_644802

(SEQ ID NO: 198)

Nucleotide sequence (variant 2):

NCBI Reference Sequence: NM_001751.5

LOCUS     NM_001751

ACCESSION  NM_001751

(SEQ ID NO: 199)

Protein sequence (variant 2):

NCBI Reference Sequence: NP_001742.1

LOCUS    NP_001742

ACCESSION  NP_001742

(SEQ ID NO: 200)

Nucleotide sequence (variant 3):

NCBI Reference Sequence: NM_001014437.2

LOCUS     NM_001014437

ACCESSION  NM_001014437

(SEQ ID NO: 201)

Protein sequence (variant 3):

NCBI Reference Sequence: NP_001014437.1

LOCUS    NP_001014437

ACCESSION  NP_001014437

(SEQ ID NO: 202)

Nucleotide sequence (variant 5):

NCBI Reference Sequence: NM_001194997.1

LOCUS     NM_001194997

ACCESSION  NM_001194997

(SEQ ID NO: 203)

Protein sequence (variant 5):

NCBI Reference Sequence: NP_001181926.1

LOCUS     NP_001181926

ACCESSION   NP_001181926

(SEQ ID NO: 204)

DDX1

Official Symbol: DDX1

Official Name: DEAD (Asp-Glu-Ala-Asp) (SEQ ID NO: 429) box helicase 1

Gene ID: 1653

Organism: Homo sapiens

Other Aliases: DBP-RB, UKVH5d

Other Designations: ATP-dependent RNA helicase DDX1; DEAD (Asp-Glu-Ala-Asp) (SEQ ID NO: 429) box polypeptide 1; DEAD (SEQ ID NO: 429) box polypeptide 1; DEAD (SEQ ID NO: 429) box protein 1; DEAD (SEQ ID NO: 429) box protein retinoblastoma; DEAD (SEQ ID NO: 429) box-1; DEAD/H (Asp-Glu-Ala-Asp/His) box polypeptide 1

Nucleotide sequence:

NCBI Reference Sequence: NM_004939.2

LOCUS     NM_004939

ACCESSION   NM_004939

(SEQ ID NO: 205)

Protein sequence:

NCBI Reference Sequence: NP_004930.1

LOCUS     NP_004930

ACCESSION NP_004930

(SEQ ID NO: 206)

CCDC22

Official Symbol: CCDC22

Official Name: coiled-coil domain containing 22

Gene ID: 28952

Organism: Homo sapiens

Other Aliases: JM1, CXorf37

Other Designations: coiled-coil domain-containing protein 22

Nucleotide sequence:

NCBI Reference Sequence: NM_014008.3

LOCUS    NM_014008

ACCESSION    NM_014008

(SEQ ID NO: 207)

Protein sequence:

NCBI Reference Sequence: NP_054727.1

LOCUS    NP_054727

ACCESSION NP_054727

(SEQ ID NO: 208)

CLIC4

Official Symbol: CLIC4

Official Name: chloride intracellular channel 4

Gene ID: 25932

Organism: Homo sapiens

Other Aliases: CLIC4L, H1, MTCLIC, huH1, p64H1

Other Designations: chloride intracellular channel 4 like; chloride intracellular channel protein 4; intracellular chloride ion channel protein p64H1

Nucleotide sequence:

>NCBI Reference Sequence: NM_013943.2

>LOCUS    NM_013943

>ACCESSION   NM_013943

>(SEQ ID NO: 209)

Protein sequence:

NCBI Reference Sequence: NP_039234.1

LOCUS    NP_039234

ACCESSION   NP_039234

(SEQ ID NO: 210)

DLD

Official Symbol: DLD

Official Name: dihydrolipoamide dehydrogenase

Gene ID: 1738

Organism: Homo sapiens

Other Aliases: tcag7.39, DLDH, E3, GCSL, LAD, PHE3

Other Designations: E3 component of pyruvate dehydrogenase complex, 2-oxo-glutarate complex, branched chain keto acid dehydrogenase complex; diaphorase; dihydrolipoyl dehydrogenase, mitochondrial; glycine cleavage system L protein; glycine cleavage system protein L; lipoamide dehydrogenase; lipoamide reductase; lipoyl dehydrogenase Nucleotide sequence:

NCBI Reference Sequence: NM_000108.3

LOCUS     NM_000108

ACCESSION   NM_000108

(SEQ ID NO: 211)

Protein sequence:

NCBI Reference Sequence: NP_000099.2

LOCUS    NP_000099

ACCESSION  NP_000099

(SEQ ID NO: 212)

ATAD3A

Official Symbol: ATAD3A

Official Name: ATPase family, AAA domain containing 3A

Gene ID: 55210

Organism: Homo sapiens

Other Aliases: RP5-832C2.1

Other Designations: ATPase family AAA domain-containing protein 3A

Nucleotide sequence (variant 1):

NCBI Reference Sequence: NM_018188.3

LOCUS     NM_018188

ACCESSION   NM_018188

(SEQ ID NO: 213)

Protein sequence (variant 1):

NCBI Reference Sequence: NP_060658.3

LOCUS    NP_060658

ACCESSION  NP_060658

(SEQ ID NO: 214)

Nucleotide sequence (variant 2):

NCBI Reference Sequence: NM_001170535.1

LOCUS    NM_001170535

ACCESSION  NM_001170535

(SEQ ID NO: 215)

Protein sequence (variant 2):

NCBI Reference Sequence: NP_001164006.1

LOCUS    NP_001164006

ACCESSION  NP_001164006

(SEQ ID NO: 216)

Nucleotide sequence (variant 3):

NCBI Reference Sequence: NM_001170536.1

LOCUS    NM_001170536

ACCESSION  NM_001170536

(SEQ ID NO: 217)

Protein sequence (variant 3):

NCBI Reference Sequence: NP_001164007.1

LOCUS    NP_001164007

ACCESSION  NP_001164007

(SEQ ID NO: 218)

PCBP2

Official Symbol: PCBP2

Official Name: poly(rC) binding protein 2

Gene ID: 5094

Organism: Homo sapiens

Other Aliases: HNRPE2, hnRNP-E2

Other Designations: alpha-CP2; heterogeneous nuclear ribonucleoprotein E2; heterogenous nuclear ribonucleoprotein E2; hnRNP E2; poly(rC)-binding protein 2

Nucleotide sequence (variant 1):

NCBI Reference Sequence: NM_005016.5

LOCUS    NM_005016.

ACCESSION    NM_005016

(SEQ ID NO: 219)

Protein sequence (variant 1):

NCBI Reference Sequence: NP_005007.2

LOCUS    NP_005007

ACCESSION    NP_005007

(SEQ ID NO: 220)

PDLIM7

Official Symbol: PDLIM7

Official Name: PDZ and LIM domain 7

Gene ID: 9260

Organism: Homo sapiens

Other Aliases: LMP1, LMP3

Other Designations: 1110003B01Rik; LIM domain protein; LMP; Lim mineralization protein 3; PDZ and LIM domain protein 7; protein enigma Nucleotide sequence (variant 1):

NCBI Reference Sequence: NM_005451.3

LOCUS    NM_005451

ACCESSION   NM_005451

(SEQ ID NO: 221)

Protein sequence (variant 1):

NCBI Reference Sequence: NP_005442.2

LOCUS    NP_005442

ACCESSION   NP_005442

(SEQ ID NO: 222)

PDCD6

Official Symbol: PDCD6

Official Name: programmed cell death 6

Gene ID: 10016

Organism: Homo sapiens

Other Aliases: ALG-2, PEF1B

Other Designations: apoptosis-linked gene 2 protein; probable calcium-binding protein ALG-2; programmed cell death protein 6

Nucleotide sequence (variant 1):

NCBI Reference Sequence: NM_013232.3

LOCUS    NM_013232

ACCESSION NM_013232

(SEQ ID NO: 223)

Protein sequence (variant 1):

NCBI Reference Sequence: NP_037364.1

LOCUS    NP_037364

ACCESSION NP_037364

(SEQ ID NO: 224)

ACTR2

Official Symbol: ACTR2

Official Name: ARP2 actin-related protein 2 homolog (yeast)

Gene ID: 10097

Organism: Homo sapiens

Other Aliases: ARP2

Other Designations: actin-like protein 2; actin-related protein 2

Nucleotide sequence (variant 1):

NCBI Reference Sequence: NM_001005386.2

LOCUS    NM_001005386

ACCESSION NM_001005386

(SEQ ID NO: 225)

Protein sequence (variant 1):

NCBI Reference Sequence: NP_001005386.1

LOCUS    NP_001005386

ACCESSION NP_001005386

(SEQ ID NO: 226)

TXNDC12

Official Symbol: TXNDC12

Official Name: thioredoxin domain containing 12 (endoplasmic reticulum)

Gene ID: 51060

Organism: Homo sapiens

Other Aliases: UNQ713/PRO1376, AG1, AGR1, ERP16, ERP18, ERP19, PDIA16, TLP19, hAG-1, hTLP19

Other Designations: ER protein 18; ER protein 19; anterior gradient homolog 1; endoplasmic reticulum protein ERp19; endoplasmic reticulum resident protein 18; endoplasmic reticulum resident protein 19; endoplasmic reticulum thioredoxin superfamily member, 18 kDa; protein disulfide isomerase family A, member 16; thioredoxin domain-containing protein 12; thioredoxin-like protein p19

Nucleotide sequence:

NCBI Reference Sequence: NM_015913.3

LOCUS    NM_015913

ACCESSION   NM_015913

(SEQ ID NO: 227)

Protein sequence:

NCBI Reference Sequence: NP_056997.1

LOCUS   NP_056997

ACCESSION   NP_056997

(SEQ ID NO: 228)

ANXA7

Official Symbol: ANXA7

Official Name: annexin A7

Gene ID: 310

Organism: Homo sapiens

Other Aliases: RP11-537A6.8, ANX7, SNX, SYNEXIN

Other Designations: annexin VII; annexin-7

Nucleotide sequence (variant 1):

NCBI Reference Sequence: NM_001156.3

LOCUS    NM_001156

ACCESSION    NM_001156

(SEQ ID NO: 229)

Protein sequence (variant 1):

NCBI Reference Sequence: NP_001147.1

LOCUS    NP_001147

ACCESSION    NP_001147

(SEQ ID NO: 230)

PFKM

Official Symbol: PFKM

Official Name: phosphofructokinase, muscle

Gene ID: 5213

Organism: Homo sapiens

Other Aliases: GSD7, PFK-1, PFK1, PFKA, PFKX

Other Designations: 6-phosphofructo-1-kinase; 6-phosphofructokinase, muscle type; PFK-A; phosphofructo-1-kinase isozyme A; phosphofructokinase 1; phosphofructokinase, polypeptide X; phosphofructokinase-M; phosphohexokinase Nucleotide sequence (variant 1):

NCBI Reference Sequence: NM_001166686.1

LOCUS    NM_001166686

ACCESSION    NM_001166686

(SEQ ID NO: 231)

Protein sequence (variant 1):

NCBI Reference Sequence: NP_001160158.1

LOCUS    NP_001160158

ACCESSION    NP_001160158

(SEQ ID NO: 232)

SUB1

Official Symbol: SUB1

Official Name: SUB1 homolog (S. cerevisiae)

Gene ID: 10923

Organism: Homo sapiens

Other Aliases: P15, PC4, p14

Other Designations: activated RNA polymerase II transcription cofactor 4; activated RNA polymerase II transcriptional coactivator p15; positive cofactor 4

Nucleotide sequence:

NCBI Reference Sequence: NM_006713.3

LOCUS    NM_006713

ACCESSION    NM_006713

(SEQ ID NO: 233)

Protein sequence:

NCBI Reference Sequence: NP_006704.3

LOCUS    NP_006704.3

ACCESSION   NP_006704.3

(SEQ ID NO: 234)

ACDB3

Official Symbol: ACBD3

Official Name: acyl-CoA binding domain containing 3

Gene ID: 64746

Organism: Homo sapiens

Other Aliases: GCP60, GOCAP1, GOLPH1, PAP7

Other Designations: Golgi resident protein GCP60; PBR- and PKA-associated protein 7; PKA (RIalpha)-associated protein; acyl-Coenzyme A binding domain containing 3; golgi complex associated protein 1, 60kDa; golgi phosphoprotein 1; peripheral benzodiazepine receptor-associated protein PAP7

Nucleotide sequence:

NCBI Reference Sequence: NM_022735.3

LOCUS    NM_022735

ACCESSION   NM_022735

(SEQ ID NO: 235)

Protein sequence:

NCBI Reference Sequence: NP_073572.2

LOCUS    NP_073572

ACCESSION   NP_073572

(SEQ ID NO: 236)

ASNA1

Official Symbol: ASNA1

Official Name: arsA arsenite transporter, ATP-binding, homolog 1 (bacterial)

Gene ID: 439

Organism: Homo sapiens

Other Aliases: ARSA-I, ARSA1, ASNA-I, GET3, TRC40, hASNA-I

Other Designations: ATPase ASNA1; arsenical pump-driving ATPase; arsenite-stimulated ATPase; golgi to ER traffic 3 homolog; transmembrane domain recognition complex 40 kDa ATPase subunit; transmembrane domain recognition complex, 40kDa Nucleotide sequence:

NCBI Reference Sequence: NM_004317.2

LOCUS    NM_004317

ACCESSION    NM_004317

(SEQ ID NO: 237)

Protein sequence:

NCBI Reference Sequence: NP_004308.2

LOCUS    NP_004308

ACCESSION    NP_004308

(SEQ ID NO: 238)

PSMD3

Official Symbol: PSMD3

Official Name: proteasome (prosome, macropain) 26S subunit, non-ATPase, 3

Gene ID: 5709

Organism: Homo sapiens

Other Aliases: P58, RPN3, S3, TSTA2

Other Designations: 26S proteasome non-ATPase regulatory subunit 3; 26S proteasome regulatory subunit RPN3; 26S proteasome regulatory subunit S3; proteasome subunit p58; tissue specific transplantation antigen 2

Nucleotide sequence:

NCBI Reference Sequence: NM_002809.3

LOCUS    NM_002809

ACCESSION   NM_002809

(SEQ ID NO: 239)

Protein sequence:

NCBI Reference Sequence: NP_002800.2

LOCUS    NP_002800

ACCESSION   NP_002800

(SEQ ID NO: 240)

IDH1

Official Symbol: IDH1

Official Name: isocitrate dehydrogenase 1 (NADP+), soluble

Gene ID: 3417

Organism: Homo sapiens

Other Aliases: IDCD, IDH, IDP, IDPC, PICD

Other Designations: NADP(+)-specific ICDH; NADP-dependent isocitrate dehydrogenase, cytosolic; NADP-dependent isocitrate dehydrogenase, peroxisomal; isocitrate dehydrogenase [NADP] cytoplasmic; oxalosuccinate decarboxylase Nucleotide sequence:

NCBI Reference Sequence: NM_005896.2

LOCUS    NM_005896

ACCESSION   NM_005896

(SEQ ID NO: 241)

Protein sequence:

NCBI Reference Sequence: NP_005887.2

LOCUS    NP_005887

ACCESSION  NP_005887

(SEQ ID NO: 242)

KPNB1

Official Symbol: KPNB1

Official Name: karyopherin (importin) beta 1

Gene ID: 3837

Organism: Homo sapiens

Other Aliases: IMB1, IPO1, IPOB, Impnb, NTF97

Other Designations: PTAC97; importin 1; importin 90; importin beta-1 subunit; importin subunit beta-1; importin-90; karyopherin subunit beta-1; nuclear factor p97; pore targeting complex 97 kDa subunit Nucleotide sequence:

NCBI Reference Sequence: NM_002265.4

LOCUS    NM_002265

ACCESSION  NM_002265

(SEQ ID NO: 243)

Protein sequence:

NCBI Reference Sequence: NP_002256.2

LOCUS    NP_002256

ACCESSION  NP_002256

(SEQ ID NO: 244)

DDX17

Official Symbol: DDX17

Official Name: DEAD (Asp-Glu-Ala-Asp) (SEQ ID NO: 429) box helicase 17

Gene ID: 10521

Organism: Homo sapiens

Other Aliases: RP3-434P1.1, P72, RH70

Other Designations: DEAD (Asp-Glu-Ala-Asp) (SEQ ID NO: 429) box polypeptide 17; DEAD (SEQ ID NO: 429) box protein p72; DEAD/H (Asp-Glu-Ala-Asp/His) box polypeptide 17 (72kD); RNA-dependent helicase p72; probable ATP-dependent RNA helicase DDX17

Nucleotide sequence (variant 1):

NCBI Reference Sequence: NM_006386.4

LOCUS    NM_006386

ACCESSION   NM_006386

(SEQ ID NO: 245)

Protein sequence (variant 1):

NCBI Reference Sequence: NP_006377.2

LOCUS    NP_006377

ACCESSION   NP_006377

(SEQ ID NO: 246)

M6PRBP1

Official Symbol: PLIN3

Official Name: perilipin 3

Gene ID: 10226

Organism: Homo sapiens

Other Aliases: M6PRBP1, PP17, TIP47

Other Designations: 47 kDa MPR-binding protein; cargo selection protein TIP47; mannose-6-phosphate receptor-binding protein 1; perilipin-3; placental protein 17; tail-interacting protein, 47 kD Nucleotide sequence (variant 1):

NCBI Reference Sequence: NM_005817.4

LOCUS     NM_005817

ACCESSION   NM_005817

(SEQ ID NO: 247)

Protein sequence (variant 1):

NCBI Reference Sequence: NP_005808.3

LOCUS   NP_005808

ACCESSION   NP_005808

(SEQ ID NO: 248)

EIF4A3

Official Symbol: EIF4A3

Official Name: eukaryotic translation initiation factor 4A3

Gene ID: 9775

Organism: Homo sapiens

Other Aliases: DDX48, NMP265, NUK34, eIF4AIII

Other Designations: ATP-dependent RNA helicase DDX48; ATP-dependent RNA helicase eIF4A-3; DEAD (Asp-Glu-Ala-Asp) (SEQ ID NO: 429) box polypeptide 48; DEAD (SEQ ID NO: 429) box protein 48; NMP 265; eIF-4A-III; eIF4A-III; eukaryotic initiation factor 4A-III; eukaryotic initiation factor 4A-like NUK-34; eukaryotic translation initiation factor 4A; hNMP 265; nuclear matrix protein 265

Nucleotide sequence:

NCBI Reference Sequence: NM_014740.3

LOCUS    NM_014740

ACCESSION   NM_014740

(SEQ ID NO: 249)

Protein sequence:

NCBI Reference Sequence: NP_055555.1

LOCUS    NP_055555

ACCESSION   NP_055555

(SEQ ID NO: 250)

IQGAP1

Official Symbol: IQGAP1

Official Name: IQ motif containing GTPase activating protein 1

Gene ID: 8826

Organism: Homo sapiens

Other Aliases: HUMORFA01, SAR1, p195

Other Designations: RasGAP-like with IQ motifs; ras GTPase-activating-like protein IQGAP1

Nucleotide sequence:

NCBI Reference Sequence: NM_003870.3

LOCUS    NM_003870

ACCESSION   NM_003870

(SEQ ID NO: 251)

Protein sequence:

NCBI Reference Sequence: NP_003861.1

LOCUS     NP_003861

ACCESSION  NP_003861

(SEQ ID NO: 252)

SFRS2

Official Symbol:SRSF2

Official Name: serine/arginine-rich splicing factor 2

Gene ID: 6427

Organism: Homo sapiens

Other Aliases: PR264, SC-35, SC35, SFRS2, SFRS2A, SRp30b

Other Designations: SR splicing factor 2; splicing component, 35 kDa; splicing factor SC35; splicing factor, arginine/serine-rich 2

Nucleotide sequence (variant 1):

NCBI Reference Sequence: NM_003016.4

LOCUS     NM_003016

ACCESSION   NM_003016

(SEQ ID NO: 253)

Protein sequence (variant 1):

NCBI Reference Sequence: NP_003007.2

LOCUS     NP_003007

ACCESSION  NP_003007

(SEQ ID NO: 254)

GOLGA3

Official Symbol: GOLGA3

Official Name: golgin A3

Gene ID: 2802

Organism: Homo sapiens

Other Aliases: GCP170, MEA-2

Other Designations: Golgi membrane associated protein; Golgi peripheral membrane protein; Golgin subfamily A member 3; SY2/SY10 protein; golgi autoantigen, golgin subfamily a, 3; golgi complex-associated protein of 170 kDa; golgin-160; golgin-165; male enhanced antigen-2

Nucleotide sequence (variant 1):

NCBI Reference Sequence: NM_005895.3

LOCUS    NM_005895

ACCESSION   NM_005895

(SEQ ID NO: 255)

Protein sequence (variant 1):

NCBI Reference Sequence: NP_005886.2

LOCUS    NP_005886

ACCESSION   NP_005886

(SEQ ID NO: 256)

PH4B

Official Symbol: P4HB

Official Name: prolyl 4-hydroxylase, beta polypeptide

Gene ID: 5034

Organism: Homo sapiens

Other Aliases: DSI, ERBA2L, GIT, P4Hbeta, PDI, PDIA1, PHDB, PO4DB, PO4HB, PROHB

Other Designations: cellular thyroid hormone-binding protein; collagen prolyl 4-hydroxylase beta; glutathione-insulin transhydrogenase; p55; procollagen-proline, 2-oxoglutarate 4-dioxygenase (proline 4-hydroxylase), beta polypeptide; prolyl 4-hydroxylase subunit beta; protein disulfide isomerase family A, member 1; protein disulfide isomerase-associated 1; protein disulfide isomerase/oxidoreductase; protein disulfide-isomerase; protocollagen hydroxylase; thyroid hormone-binding protein p55

Nucleotide sequence:

NCBI Reference Sequence: NM_000918.3

LOCUS    NM_000918

ACCESSION    NM_000918

(SEQ ID NO: 257)

Protein sequence:

NCBI Reference Sequence: NP_000909.2

LOCUS    NP_000909

ACCESSION    NP_000909

(SEQ ID NO: 258)

HSPA1A

Official Symbol: HSPA1A

Official Name: heat shock 70kDa protein 1A

Gene ID: 3303

Organism: Homo sapiens

Other Aliases: DAQB-147D11.1, HSP70-1, HSP70-1A, HSP70I, HSP72, HSPA1

Other Designations: HSP70-1/HSP70-2; HSP70.1/HSP70.2; dnaK-type molecular chaperone HSP70-1; heat shock 70 kDa protein 1/2; heat shock 70 kDa protein 1A/1B; heat shock 70kD protein 1A; heat shock-induced protein Nucleotide sequence:

NCBI Reference Sequence: NM_005345.5

LOCUS    NM_005345

ACCESSION    NM_005345

(SEQ ID NO: 259)

Protein sequence:

NCBI Reference Sequence: NP_005336.3

LOCUS    NP_005336

ACCESSION    NP_005336

(SEQ ID NO: 260)

---

Gene

Official Symbol: HNRNPD

Official Name: heterogeneous nuclear ribonucleoprotein D (AU-rich element RNA binding protein 1, 37kDa)

Gene ID: 3184

Organism: Homo sapiens

Other Aliases: AUF1, AUF1A, HNRPD, P37, hnRNPD0

Other Designations: ARE-binding protein AUFI, type A; heterogeneous nuclear ribonucleoprotein D0; hnRNP D0

Nucleotide sequence: ISOFORM D

NCBI Reference Sequence: NM_001003810.1

LOCUS    NM_001003810

ACCESSION    NM_001003810

(SEQ ID NO: 261)

Protein sequence: ISOFORM D

NCBI Reference Sequence: NP_001003810.1

LOCUS  NP_001003810

ACCESSION  NP_001003810

(SEQ ID NO: 262)

Nucleotide sequence: ISOFORM C

NCBI Reference Sequence: NM_002138.3

LOCUS    NM_002138

ACCESSION  NM_002138

(SEQ ID NO: 263)

Protein sequence: ISOFORM C

NCBI Reference Sequence: NP_002129.2

LOCUS  NP_002129

ACCESSION  NP_002129

(SEQ ID NO: 264)

Nucleotide sequence: ISOFORM B

NCBI Reference Sequence: NM_031369.2

LOCUS  NM_031369

ACCESSION  NM_031369
    (SEQ ID NO: 265)

Protein sequence: ISOFORM B

NCBI Reference Sequence: NP_112737.1

LOCUS  NP_112737

ACCESSION NP_112737

(SEQ ID NO: 266)

Nucleotide sequence: ISOFORM A

NCBI Reference Sequence: NM_031370.2

LOCUS NM_031370

ACCESSION NM_031370

(SEQ ID NO: 267)

Protein sequence: ISOFORM A

NCBI Reference Sequence: NP_112738.1

LOCUS NP_112738

ACCESSION NP_112738

(SEQ ID NO: 268)

---

RPL32

Official Symbol: RPL32

Official Name: ribosomal protein L32

Gene ID: 6161

Organism: Homo sapiens

Other Aliases: AU020185, rpL32-3A

Other Designations: 60S ribosomal protein L32; snoRNA MBI-141

Nucleotide sequence: Transcript Variant 1

NCBI Reference Sequence: NM_000994.3

LOCUS NM_000994

ACCESSION NM_000994

(SEQ ID NO: 269)

Protein sequence: Transcript Variant 1.

NCBI Reference Sequence: NP_000985.1

LOCUS    NP_000985

ACCESSION   NP_000985

(SEQ ID NO: 270)

Nucleotide sequence:  Transcript Variant 2.

NCBI Reference Sequence: NM_001007073.1

LOCUS  NM_001007073

ACCESSION   NM_001007073

(SEQ ID NO: 271)

Protein sequence: Transcript Variant 2.

NCBI Reference Sequence: NP_001007074.1

LOCUS    NP_001007074

ACCESSION   NP_001007074

(SEQ ID NO: 272)

Nucleotide sequence:   Transcript Variant 3.

NCBI Reference Sequence:  NM_001007074.1

LOCUS    NM_001007074

ACCESSION   NM_001007074

(SEQ ID NO: 273)

Protein sequence: Transcript Variant 3.

NCBI Reference Sequence: NP_001007075.1

LOCUS    NP_001007075

ACCESSION    NP_001007075

(SEQ ID NO: 274)

---

Gene

Official Symbol: ATP5H

Official Name: ATP synthase, H+ transporting, mitochondrial Fo complex, subunit d Gene ID: 10476

Organism: Homo sapiens

Other Aliases: My032, ATPQ

Other Designations: ATP synthase D chain, mitochondrial; ATP synthase subunit d, mitochondrial; ATP synthase, H+ transporting, mitochondrial F0 complex, subunit d; ATP synthase, H+ transporting, mitochondrial F1F0, subunit d; ATPase subunit d; My032 protein Nucleotide sequence: ISOFORM B

NCBI Reference Sequence: NM_001003785.1

LOCUS    NM_001003785

ACCESSION    NM_001003785

(SEQ ID NO: 275)

Protein sequence: ISOFORM B

NCBI Reference Sequence: NP_001003785.1

LOCUS    NP_001003785

ACCESSION    NP_001003785

(SEQ ID NO: 276)

Nucleotide sequence: ISOFORM A

NCBI Reference Sequence: NM_006356.2

LOCUS    NM_006356

ACCESSION   NM_006356

(SEQ ID NO: 277)

Protein sequence: ISOFORM A

NCBI Reference Sequence: NP_006347.1

LOCUS   NP_006347

ACCESSION   NP_006347

(SEQ ID NO: 278)

------------------------------------------

PSMA1

Official Symbol: PSMA1

Official Name: proteasome (prosome, macropain) subunit, alpha type, 1

Gene ID: 5682

Organism: Homo sapiens

Other Aliases: HC2, NU, PROS30

Other Designations: 30 kDa prosomal protein; PROS-30; macropain subunit C2; macropain subunit nu; multicatalytic endopeptidase complex subunit C2; proteasome component C2; proteasome nu chain; proteasome subunit alpha type-1; proteasome subunit nu; proteasome subunit, alpha-type, 1; protein P30-33K Nucleotide sequence: ISOFORM 3

NCBI Reference Sequence: NM_001143937.1

LOCUS NM_001143937

ACCESSION NM_001143937

(SEQ ID NO: 279)

Protein sequence: ISOFORM 3

NCBI Reference Sequence: NP_001137409.1

LOCUS NP_001137409

ACCESSION NP_001137409

(SEQ ID NO: 280)

Nucleotide sequence: ISOFORM 2

NCBI Reference Sequence: NM_002786.3

LOCUS NM_002786

ACCESSION NM_002786

(SEQ ID NO: 281)

Protein sequence: ISOFORM 2

NCBI Reference Sequence: NP_002777.1

LOCUS NP_002777

ACCESSION NP_002777

(SEQ ID NO: 282)

Nucleotide sequence: ISOFORM 1

NCBI Reference Sequence: NM_148976.2

LOCUS NM_148976

ACCESSION NM_148976

(SEQ ID NO: 283)

Protein sequence: ISOFORM 1

NCBI Reference Sequence: NP_683877.1

LOCUS NP_683877

ACCESSION NP_683877

(SEQ ID NO: 284)

---

PTBP1

Official Symbol: PTBP1

Official Name: polypyrimidine tract binding protein 1

Gene ID: 5725

Organism: Homo sapiens

Other Aliases: HNRNP-I, HNRNPI, HNRPI, PTB, PTB-1, PTB-T, PTB2, PTB3, PTB4, pPTB Other Designations: 57 kDa RNA-binding protein PPTB-1; RNA-binding protein; heterogeneous nuclear ribonucleoprotein I; heterogeneous nuclear ribonucleoprotein polypeptide I; hnRNP I; polypyrimidine tract binding protein (heterogeneous nuclear ribonucleoprotein I); polypyrimidine tract-binding protein 1

Nucleotide sequence: ISOFORM A

NCBI Reference Sequence: NM_002819.4

LOCUS NM_002819

ACCESSION NM_002819

(SEQ ID NO: 285)

Protein sequence: ISOFORM A

NCBI Reference Sequence: NP_002810.1

LOCUS    NP_002810

ACCESSION   NP_002810

(SEQ ID NO: 286)

Nucleotide sequence: ISOFORM B

NCBI Reference Sequence: NM_031990.3

LOCUS   NM_031990

ACCESSION   NM_031990

(SEQ ID NO: 287)

Protein sequence: ISOFORM B

NCBI Reference Sequence: NP_114367.1

LOCUS    NP_114367

ACCESSION   NP_114367

(SEQ ID NO: 288)

Nucleotide sequence: ISOFORM C

NCBI Reference Sequence: NM_031991.3

LOCUS   NM_031991

ACCESSION   NM_031991

(SEQ ID NO: 289)

Protein sequence: ISOFORM C

> NCBI Reference Sequence: NP_114368.1
>
> LOCUS   NP_114368
>
> ACCESSION   NP_114368
>
> (SEQ ID NO: 290)

---

AP2A1

Official Symbol: AP2A1

Official Name: adaptor-related protein complex 2, alpha 1 subunit

Gene ID: 160

Organism: Homo sapiens

Other Aliases: ADTAA, AP2-ALPHA, CLAPA1

Other Designations: 100 kDa coated vesicle protein A; AP-2 complex subunit alpha-1; adapter-related protein complex 2 alpha-1 subunit; adaptin, alpha A; adaptor protein complex AP-2 subunit alpha-1; alpha-adaptin A; alpha1-adaptin; clathrin assembly protein complex 2 alpha-A large chain; clathrin-associated/assembly/adaptor protein, large, alpha 1; plasma membrane adaptor HA2/AP2 adaptin alpha A subunit Nucleotide sequence: ISOFORM 1

> NCBI Reference Sequence: NM_014203.2
>
> LOCUS   NM_014203
>
> ACCESSION   NM_014203
>
> (SEQ ID NO: 291)

Protein sequence: ISOFORM 1

> NCBI Reference Sequence: NP_055018.2
>
> LOCUS   NP_055018

ACCESSION  NP_055018

(SEQ ID NO: 292)

Nucleotide sequence: ISOFORM 2

NCBI Reference Sequence:  NM_130787.2

LOCUS   NM_130787

ACCESSION  NM_130787

(SEQ ID NO: 293)

Protein sequence: ISOFORM 2

NCBI Reference Sequence:  NP_570603.2

LOCUS   NP_570603

ACCESSION  NP_570603

(SEQ ID NO: 294)

---

TTLL12

Official Symbol: TTLL12

Official Name:  tubulin tyrosine ligase-like family, member 12

Gene ID: 23170

Organism: Homo sapiens

Other Aliases: dJ526I14.2

Other Designations:  tubulin--tyrosine ligase-like protein 12

Nucleotide sequence:

NCBI Reference Sequence:  NM_015140.3

LOCUS   NM_015140

ACCESSION   NM_015140

(SEQ ID NO: 295)

//

Protein sequence:

NCBI Reference Sequence:  NP_055955.1

LOCUS   NP_055955

ACCESSION   NP_055955

(SEQ ID NO: 296)

//

---

FERMT2

Official Symbol: FERMT2

Official Name: fermitin family member 2

Gene ID: 10979

Organism: Homo sapiens

Other Aliases: KIND2, MIG2, PLEKHC1, UNC112, UNC112B, mig-2

Other Designations: PH domain-containing family C member 1; fermitin family homolog 2; kindlin 2; kindlin-2; mitogen inducible gene 2 protein; mitogen-inducible gene 2 protein; pleckstrin homology domain containing, family C (with FERM domain) member 1; pleckstrin homology domain containing, family C member 1; pleckstrin homology domain-containing family C member Nucleotide sequence:

NCBI Reference Sequence:  NM_001134999.1

LOCUS   NM_001134999

ACCESSION   NM_001134999

(SEQ ID NO: 297)

//

Protein sequence:

NCBI Reference Sequence: NP_001128471.1

LOCUS   NP_001128471

ACCESSION   NP_001128471

(SEQ ID NO: 298)

---

ANXA6

Official Symbol: ANXA6

Official Name: annexin A6

Gene ID: 309

Organism: Homo sapiens

Other Aliases: ANX6, CBP68

Other Designations: 67 kDa calelectrin; CPB-II; annexin VI (p68); annexin-6; calcium-binding protein p68; calelectrin; calphobindin II; calphobindin-II; chromobindin-20; lipocortin VI; p68; p70

Nucleotide sequence:

NCBI Reference Sequence: NM_001155.4

LOCUS   NM_001155

ACCESSION   NM_001155
(SEQ ID NO: 299)
//

Protein sequence:

NCBI Reference Sequence: NP_001146.2

LOCUS   NP_001146

ACCESSION NP_001146

(SEQ ID NO: 300)

//

---

PSMD4

Official Symbol: PSMD4

Official Name: proteasome (prosome, macropain) 26S subunit, non-ATPase, 4

Gene ID: 5710

Organism: Homo sapiens

Other Aliases: RP11-126K1.1, AF, AF-1, ASF, MCB1, Rpn10, S5A, pUB-R5

Other Designations: 26S proteasome non-ATPase regulatory subunit 4; 26S proteasome regulatory subunit S5A; RPN10 homolog; S5a/antisecretory factor protein; angiocidin; antisecretory factor 1; multiubiquitin chain-binding protein Nucleotide sequence:

NCBI Reference Sequence: NM_002810.2

LOCUS   NM_002810

ACCESSION   NM_002810

(SEQ ID NO: 301)

//

Protein sequence:

NCBI Reference Sequence: NP_002801.1

LOCUS   NP_002801

ACCESSION   NP_002801

(SEQ ID NO: 302)

//

---

COTL1

Official Symbol: COTL1

Official Name: coactosin-like 1 (Dictyostelium)

Gene ID: 23406

Organism: Homo sapiens

Other Aliases: CLP

Other Designations: coactosin-like protein

Nucleotide sequence:

NCBI Reference Sequence: NM_021149.2

LOCUS    NM_021149

ACCESSION    NM_021149

(SEQ ID NO: 303)
//

Protein sequence:

NCBI Reference Sequence: NP_066972.1

LOCUS    NP_066972

ACCESSION    NP_066972

(SEQ ID NO: 304)
//

---

ST13

Official Symbol: ST13

Official Name: suppression of tumorigenicity 13

Gene ID: 6767

Organism: Homo sapiens

Other Aliases: AAG2, FAM10A1, FAM10A4, HIP, HOP, HSPABP, HSPABP1, P48, PRO0786, SNC6

Other Designations: Hsp70-interacting protein; aging-associated protein 2; heat shock 70kD protein binding protein; hsc70-interacting protein; progesterone receptor-associated p48 protein; putative tumor suppressor ST13; renal carcinoma antigen NY-REN-33; suppression of tumorigenicity 13 protein Nucleotide sequence:

NCBI Reference Sequence: NM_003932.3

LOCUS    NM_003932

ACCESSION   NM_003932

(SEQ ID NO: 305)

//

Protein sequence:

NCBI Reference Sequence: NP_003923.2

LOCUS    NP_003923

ACCESSION  NP_003923

(SEQ ID NO: 306)

//

---

Gene

Official Symbol: SRSF2 (also known as SFRS2)

Official Name: serine/arginine-rich splicing factor 2

Gene ID: 6427

Organism: Homo sapiens

Other Aliases: PR264, SC-35, SC35, SFRS2, SFRS2A, SRp30b

Other Designations: SR splicing factor 2; splicing component, 35 kDa; splicing factor SC35; splicing factor, arginine/serine-rich 2

Nucleotide sequence:

NCBI Reference Sequence: NM_001195427.1

LOCUS    NM_001195427

ACCESSION   NM_001195427

(SEQ ID NO: 307)

//

Protein sequence:

NCBI Reference Sequence: NP_001182356.1

LOCUS    NP_001182356

ACCESSION  NP_001182356

(SEQ ID NO: 308)

//

---

HNRNPH1

Official Symbol: HNRNPH1

Official Name: heterogeneous nuclear ribonucleoprotein H1 (H)

Gene ID: 3187

Organism: Homo sapiens

Other Aliases: HNRPH, HNRPH1, hnRNPH

Other Designations: heterogeneous nuclear ribonucleoprotein H

Nucleotide sequence:

NCBI Reference Sequence: NM_001257293.1

LOCUS    NM_001257293

ACCESSION  NM_001257293

(SEQ ID NO: 309)

//

Protein sequence:

NCBI Reference Sequence: NP_001244222.1

LOCUS    NP_001244222

ACCESSION  NP_001244222

(SEQ ID NO: 310)

//

---

Gene

Official Symbol: IQGAP1

Official Name: IQ motif containing GTPase activating protein 1

Gene ID: 8826

Organism: Homo sapiens

Other Aliases: HUMORFA01, SAR1, p195

Other Designations: RasGAP-like with IQ motifs; ras GTPase-activating-like protein IQGAP1

Nucleotide sequence:

NCBI Reference Sequence: NM_003870.3

LOCUS    NM_003870

ACCESSION  NM_003870

(SEQ ID NO: 311)

//

Protein sequence:

NCBI Reference Sequence: NP_003861.1

LOCUS    NP_003861

ACCESSION NP_003861

(SEQ ID NO: 312)

//

---

GPSN2

Official Symbol: TECR (also known as GPSN2)

Official Name: trans-2,3-enoyl-CoA reductase

Gene ID: 9524

Organism: Homo sapiens

Other Aliases: GPSN2, MRT14, SC2, TER

Other Designations: glycoprotein, synaptic 2; synaptic glycoprotein SC2

Nucleotide sequence:

NCBI Reference Sequence: NM_138501.5

LOCUS    NM_138501

ACCESSION    NM_138501 XM_001132190 XM_001132196

(SEQ ID NO: 313)

//

Protein sequence:

NCBI Reference Sequence: NP_612510.1

LOCUS    NP_612510

ACCESSION NP_612510 XP_001132190 XP_001132196

(SEQ ID NO: 314)

//

---

EHD2

Official Symbol: EHD2

Official Name: EH-domain containing 2

Gene ID: 30846

Organism: Homo sapiens

Other Aliases: PAST2

Other Designations: EH domain containing 2; EH domain-containing protein 2; PAST homolog 2

Nucleotide sequence:

NCBI Reference Sequence: NM_014601.3

LOCUS    NM_014601

ACCESSION   NM_014601
    (SEQ ID NO: 315)

//

Protein sequence:

NCBI Reference Sequence: NP_055416.2

LOCUS    NP_055416

ACCESSION  NP_055416

(SEQ ID NO: 316)

//

---

UGP2

Official Symbol: UGP2

Official Name: UDP-glucose pyrophosphorylase 2

Gene ID: 7360

Organism: Homo sapiens

Other Aliases: UDPG, UDPGP2, UGP1, UGPP1, UGPP2, pHC379

Other Designations: UDP-glucose diphosphorylase; UDP-glucose pyrophosphorylase 1; UDPGP; UGPase 2; UTP--glucose-1-phosphate uridylyltransferase; UTP--glucose-1-phosphate uridylyltransferase 2; UTP-glucose-1-phosphate uridyltransferase; uridyl diphosphate glucose pyrophosphorylase 2

Nucleotide sequence:

NCBI Reference Sequence: NM_001001521.1

LOCUS    NM_001001521

ACCESSION   NM_001001521

(SEQ ID NO: 317)

//

Protein sequence:

NCBI Reference Sequence: NP_001001521.1

LOCUS   NP_001001521

ACCESSION NP_001001521

(SEQ ID NO: 318)

//

---

UGDH

Official Symbol: UGDH

Official Name: UDP-glucose 6-dehydrogenase

Gene ID: 7358

Organism: Homo sapiens

Other Aliases: GDH, UDP-GlcDH, UDPGDH, UGD

Other Designations: UDP-Glc dehydrogenase; UDP-glucose dehydrogenase; uridine diphospho-glucose dehydrogenase Nucleotide sequence:

NCBI Reference Sequence: NM_001184700.1

LOCUS: NM_001184700

ACCESSION : NM_001184700

(SEQ ID NO: 319)

//

Protein sequence:

NCBI Reference Sequence: NP_001171629.1

LOCUS: NP_001171629

ACCESSION: NP_001171629

(SEQ ID NO: 320)

//

---

Gene

Official Symbol: PLIN3 (also known as M6PRBP1)

Official Name: perilipin 3

Gene ID: 10226

Organism: Homo sapiens

Other Aliases: M6PRBP1, PP17, TIP47

Other Designations: 47 kDa MPR-binding protein; cargo selection protein TIP47; mannose-6-phosphate receptor-binding protein 1; perilipin-3; placental protein 17; tail-interacting protein, 47 kD Nucleotide sequence:

NCBI Reference Sequence: NM_001164189.1

LOCUS: NM_001164189

ACCESSION: NM_001164189

(SEQ ID NO: 321)

//

Protein sequence:

NCBI Reference Sequence: NP_001157661.1

LOCUS: NP_001157661

ACCESSION: NP_001157661

(SEQ ID NO: 322)

//

---

C14orf166

Official Symbol: C14orf166

Official Name: chromosome 14 open reading frame 166

Gene ID: 51637

Organism: Homo sapiens

Other Aliases: CGI-99, CGI99, CLE, CLE7, LCRP369, RLLM1

Other Designations: CLE7 homolog; RLL motif containing 1; UPF0568 protein C14orf166

Nucleotide sequence:

NCBI Reference Sequence: NM_016039.2

LOCUS: NM_016039

ACCESSION: NM_016039

(SEQ ID NO: 323)

//

Protein sequence:

NCBI Reference Sequence: NP_057123.1

LOCUS: NP_057123

ACCESSION: NP_057123

(SEQ ID NO: 324)
//

---

SNRNP70

Official Symbol: SNRNP70

Official Name: small nuclear ribonucleoprotein 70kDa (U1)

Gene ID: 6625

Organism: Homo sapiens

Other Aliases: RNPU1Z, RPU1, SNRP70, Snp1, U1-70K, U170K, U1AP, U1RNP

Other Designations: U1 small nuclear ribonucleoprotein 70 kDa; U1 snRNP 70 kDa

Nucleotide sequence:

NCBI Reference Sequence: NM_003089.4

LOCUS: NM_003089

ACCESSION : NM_003089

(SEQ ID NO: 325)
//

Protein sequence:

NCBI Reference Sequence: NP_003080.2

LOCUS: NP_003080

ACCESSION: NP_003080

(SEQ ID NO: 326)
//

---

CNN2

Official Symbol: CNN2

Official Name: calponin 2

Gene ID: 1265

Organism: Homo sapiens

Other Aliases: none

Other Designations: calponin H2, smooth muscle; calponin-2; neutral calponin

Nucleotide sequence:

NCBI Reference Sequence: NM_004368.2

LOCUS: NM_004368

ACCESSION : NM_004368

(SEQ ID NO: 327)

//

Protein sequence:

NCBI Reference Sequence: NP_004359.1

LOCUS: NP_004359

ACCESSION: NP_004359

(SEQ ID NO: 328)

//

---

PEBP1

Official Symbol: PEBP1

Official Name: phosphatidylethanolamine binding protein 1

Gene ID: 5037

Organism: Homo sapiens

Other Aliases: HCNP, HCNPpp, PBP, PEBP, PEBP-1, RKIP

Other Designations: Raf kinase inhibitory protein; hippocampal cholinergic neurostimulating peptide; neuropolypeptide h3; phosphatidylethanolamine-binding protein 1; prostatic binding protein; prostatic-binding protein; raf kinase inhibitor protein Nucleotide sequence:

NCBI Reference Sequence: NM_002567.2

LOCUS: NM_002567

ACCESSION : NM_002567 XR_109136 XR_109137 XR_111344 XR_114620

(SEQ ID NO: 329)

//

Protein sequence:

NCBI Reference Sequence: NP_002558.1

LOCUS: NP_002558

ACCESSION: NP_002558

(SEQ ID NO: 330)

//

---

ACLY

Official Symbol: ACLY

Official Name: ATP citrate lyase

Gene ID: 47

Organism: Homo sapiens

Other Aliases: ACL, ATPCL, CLATP

Other Designations: ATP citrate synthase; ATP-citrate (pro-S-)-lyase; ATP-citrate synthase; citrate cleavage enzyme Nucleotide sequence:

NCBI Reference Sequence: NM_001096.2

LOCUS: NM_001096

ACCESSION : NM_001096

(SEQ ID NO: 331)
//

Protein sequence:

NCBI Reference Sequence: NP_001087.2

LOCUS: NP_001087

ACCESSION: NP_001087

(SEQ ID NO: 332)
//

---

SNX12

Official Symbol: SNX12

Official Name: sorting nexin 12

Gene ID: 29934

Organism: Homo sapiens

Other Aliases: none

Other Designations: sorting nexin-12

Nucleotide sequence:

NCBI Reference Sequence: NM_001256185.1

LOCUS: NM_001256185

ACCESSION : NM_001256185

(SEQ ID NO: 333)
//

Protein sequence:

NCBI Reference Sequence: NP_001243114.1

LOCUS: NP_001243114

ACCESSION: NP_001243114

(SEQ ID NO: 334)

//

---

SYNCRIP

Official Symbol: SYNCRIP

Official Name: synaptotagmin binding, cytoplasmic RNA interacting protein

Gene ID: 10492

Organism: Homo sapiens

Other Aliases: RP1-3J17.2, GRY-RBP, GRYRBP, HNRPQ1, NSAP1, PP68, hnRNP-Q

Other Designations: NS1-associated protein 1; glycine- and tyrosine-rich RNA-binding protein; heterogeneous nuclear ribonucleoprotein Q Nucleotide sequence:

NCBI Reference Sequence: NM_001159673.1

LOCUS: NM_001159673

ACCESSION : NM_001159673

(SEQ ID NO: 335)

//

Protein sequence:

NCBI Reference Sequence: NP_001153145.1

LOCUS: NP_001153145

ACCESSION: NP_001153145

(SEQ ID NO: 336)

//

---

SAR1B

Official Symbol: SAR1B

Official Name: SAR1 homolog B (S. cerevisiae)

Gene ID: 51128

Organism: Homo sapiens

Other Aliases: ANDD, CMRD, GTBPB, SARA2

Other Designations: 2310075M17Rik; GTP-binding protein B; GTP-binding protein SAR1b; GTP-binding protein Sara; SAR1a gene homolog 2

Nucleotide sequence:

NCBI Reference Sequence: NM_001033503.2

LOCUS: NM_001033503

ACCESSION : NM_001033503

(SEQ ID NO: 337)

//

Protein sequence:

NCBI Reference Sequence: NP_001028675.1

LOCUS: NP_001028675

ACCESSION: NP_001028675

(SEQ ID NO: 338)

//

CCDC47

Official Symbol: CCDC47

Official Name: coiled-coil domain containing 47

Gene ID: 57003

Organism: Homo sapiens

Other Aliases: GK001, MSTP041

Other Designations: coiled-coil domain-containing protein 47

Nucleotide sequence:

NCBI Reference Sequence: NM_020198.2

LOCUS: NM_020198

ACCESSION : NM_020198

(SEQ ID NO: 339)
//

Protein sequence:

NCBI Reference Sequence: NP_064583.2

LOCUS: NP_064583

ACCESSION: NP_064583

(SEQ ID NO: 340)
//

PSMD12

Official Symbol: PSMD12

Official Name: proteasome (prosome, macropain) 26S subunit, non-ATPase, 12

Gene ID: 5718

Organism: Homo sapiens

Other Aliases: Rpn5, p55

Other Designations: 26S proteasome non-ATPase regulatory subunit 12; 26S proteasome regulatory subunit RPN5; 26S proteasome regulatory subunit p55

Nucleotide sequence:

NCBI Reference Sequence: NM_002816.3

LOCUS: NM_002816

ACCESSION: NM_002816 XM_942494 XM_946044 XM_946047 XM_946049 XM_946052 XM_946055 XM_946058

(SEQ ID NO: 341)
//

Protein sequence:

NCBI Reference Sequence: NP_002807.1

LOCUS: NP_002807

ACCESSION: NP_002807 XP_947587 XP_951137 XP_951140 XP_951142 XP_951145 XP_951148 XP_951151

(SEQ ID NO: 342)
//

ATP5F1

Official Symbol: ATP5F1

Official Name: ATP synthase, H+ transporting, mitochondrial Fo complex, subunit B1

Gene ID: 515

Organism: Homo sapiens

Other Aliases: RP11-552M11.5, PIG47

Other Designations: ATP synthase B chain, mitochondrial; ATP synthase subunit b, mitochondrial; ATP synthase, H+ transporting, mitochondrial F0 complex, subunit B1; ATP synthase, H+ transporting, mitochondrial F0 complex, subunit b; ATPase subunit b; H+-ATP synthase subunit b; cell proliferation-inducing protein 47

Nucleotide sequence:

>NCBI Reference Sequence: NM_001688.4

>LOCUS    NM_001688

>ACCESSION   NM_001688

>(SEQ ID NO: 343)

Protein sequence:

NCBI Reference Sequence: NP_001679.2

LOCUS   NP_001679

ACCESSION   NP_001679

(SEQ ID NO: 344)

CMPK1

Official Symbol: CMPK1

Official Name: cytidine monophosphate (UMP-CMP) kinase 1, cytosolic

Gene ID: 51727

Organism: Homo sapiens

Other Aliases: RP11-511I2.1, CMK, CMPK, UMK, UMP-CMPK, UMPK

Other Designations: UMP-CMP kinase; UMP/CMP kinase; cytidylate kinase; deoxycytidylate kinase; uridine monophosphate kinase; uridine monophosphate/cytidine monophosphate kinase Nucleotide sequence:

>NCBI Reference Sequence (variant 1): NM_016308.2

>LOCUS    NM_016308

ACCESSION NM_016308

(SEQ ID NO: 345)

Protein sequence (variant 1):

NCBI Reference Sequence: NP_057392.1

LOCUS    NP_057392

ACCESSION  NP_057392

(SEQ ID NO: 346)

COX6B1

Official Symbol: COX6B1

Official Name: cytochrome c oxidase subunit VIb polypeptide 1 (ubiquitous)

Gene ID: 1340

Organism: Homo sapiens

Other Aliases: COX6B, COXG, COXVIb1

Other Designations: COX VIb-1; cytochrome c oxidase subunit 6B1

Nucleotide sequence:

NCBI Reference Sequence: NM_001863.4

LOCUS    NM_001863

ACCESSION  NM_001863

(SEQ ID NO: 347)

Protein sequence:

NCBI Reference Sequence: NP_001854.1

LOCUS    NP_001854

ACCESSION  NP_001854

(SEQ ID NO: 348)

CTSA

Official Symbol: CTSA

Official Name: cathepsin A

Gene ID: 5476

Organism: Homo sapiens

Other Aliases: RP3-337O18.1, GLB2, GSL, NGBE, PPCA, PPGB

Other Designations: beta-galactosidase 2; beta-galactosidase protective protein; carboxypeptidase C; carboxypeptidase L; carboxypeptidase Y-like kininase; carboxypeptidase-L; deamidase; lysosomal carboxypeptidase A; lysosomal protective protein; protective protein cathepsin A; urinary kininase Nucleotide sequence (variant 1):

NCBI Reference Sequence: NM_000308.2

LOCUS    NM_000308

ACCESSION    NM_000308

(SEQ ID NO: 349)

Protein sequence (variant 1):

NCBI Reference Sequence: NP_000299.2

LOCUS    NP_000299

ACCESSION    NP_000299

(SEQ ID NO: 350)

EPHX1

Official Symbol: EPHX1

Official Name: epoxide hydrolase 1, microsomal (xenobiotic)

Gene ID: 2052

Organism: Homo sapiens

Other Aliases: EPHX, EPOX, HYL1, MEH

Other Designations: epoxide hydratase; epoxide hydrolase 1

Nucleotide sequence: (variant 1)

NCBI Reference Sequence: NM_000120.3

LOCUS     NM_000120

ACCESSION   NM_000120

(SEQ ID NO: 351)

Protein sequence (variant 1):

NCBI Reference Sequence: NP_000111.1

LOCUS    NP_000111

ACCESSION   NP_000111

(SEQ ID NO: 352)

ATP5B

Official Symbol: ATP5B

Official Name: ATP synthase, H+ transporting, mitochondrial F1 complex, beta polypeptide Gene ID: 506

Organism: Homo sapiens

Other Aliases: ATPMB, ATPSB

Other Designations: ATP synthase subunit beta, mitochondrial; mitochondrial ATP synthase beta subunit; mitochondrial ATP synthetase, beta subunit Nucleotide sequence:

NCBI Reference Sequence: NM_001686.3

LOCUS    NM_001686

ACCESSION    NM_001686

(SEQ ID NO: 353)

Protein sequence:

NCBI Reference Sequence: NP_001677.2

LOCUS    NP_001677

ACCESSION    NP_001677

(SEQ ID NO: 354)

ATP5D

Official Symbol: ATP5D

Official Name: ATP synthase, H+ transporting, mitochondrial F1 complex, delta subunit Gene ID: 513

Organism: Homo sapiens

Other Aliases: None currently listed

Other Designations: ATP synthase subunit delta, mitochondrial; F-ATPase delta subunit; mitochondrial ATP synthase complex delta-subunit precusor; mitochondrial ATP synthase, delta subunit Nucleotide sequence (variant 1):

NCBI Reference Sequence: NM_001687.4

LOCUS    NM_001687

ACCESSION    NM_001687

(SEQ ID NO: 355)

Protein sequence (variant 1):

NCBI Reference Sequence: NP_001678.1

LOCUS    NP_001678

ACCESSION NP_001678

(SEQ ID NO: 356)

CAPN1

Official Symbol: CAPN1

Official Name: calpain 1, (mu/I) large subunit

Gene ID: 823

Organism: Homo sapiens

Other Aliases: PIG30, CANP, CANP1, CANPL1, muCANP, muCL

Other Designations: CANP 1; calcium-activated neutral proteinase 1; calpain mu-type; calpain, large polypeptide L1; calpain-1 catalytic subunit; calpain-1 large subunit; cell proliferation-inducing gene 30 protein; cell proliferation-inducing protein 30; micromolar-calpain Nucleotide sequence (variant 1):

NCBI Reference Sequence: NM_001198868.1

LOCUS    NM_001198868

ACCESSION   NM_001198868

(SEQ ID NO: 357)

Protein sequence (variant 1):

NCBI Reference Sequence: NP_001185797.1

LOCUS   NP_001185797

ACCESSION  NP_001185797

(SEQ ID NO: 358)

CAPZA2

Official Symbol: CAPZA2

Official Name: capping protein (actin filament) muscle Z-line, alpha 2

Gene ID: 830

Organism: Homo sapiens

Other Aliases: CAPPA2, CAPZ

Other Designations: F-actin capping protein alpha-2 subunit; F-actin-capping protein subunit alpha-2; capZ alpha-2

Nucleotide sequence:

NCBI Reference Sequence: NM_006136.2

LOCUS    NM_006136

ACCESSION   NM_006136

(SEQ ID NO: 359)

Protein sequence:

NCBI Reference Sequence: NP_006127.1

LOCUS    NP_006127

ACCESSION   NP_006127

(SEQ ID NO: 360)

CCT7

Official Symbol: CCT7

Official Name: chaperonin containing TCP1, subunit 7 (eta)

Gene ID: 10574

Organism: Homo sapiens

Other Aliases: CCTETA, CCTH, NIP7-1, TCP1ETA

Other Designations: CCT-eta; HIV-1 Nef interacting protein; HIV-1 Nef-interacting protein; T-complex protein 1 subunit eta; TCP-1-eta; chaperonin containing t-complex polypeptide 1, eta subunit Nucleotide sequence (variant 1):

>    NCBI Reference Sequence: NM_006429.3
>
>    LOCUS    NM_006429
>
>    ACCESSION    NM_006429
>
>    (SEQ ID NO: 361)

Protein sequence (variant 1):

NCBI Reference Sequence: NP_006420.1

LOCUS    NP_006420

ACCESSION    NP_006420

(SEQ ID NO: 362)

CTSB

Official Symbol: CTSB

Official Name: cathepsin B

Gene ID: 1508

Organism: Homo sapiens

Other Aliases: APPS, CPSB

Other Designations: APP secretase; amyloid precursor protein secretase; cathepsin B1; cysteine protease Nucleotide sequence (variant 1):

>    NCBI Reference Sequence: NM_001908.3
>
>    LOCUS    NM_001908
>
>    ACCESSION    NM_001908

(SEQ ID NO: 363)

Protein sequence (variant 1):

NCBI Reference Sequence: NP_001899.1

LOCUS   NP_001899

ACCESSION   NP_001899

(SEQ ID NO: 364)

FKBP2

Official Symbol: FKBP2

Official Name: FK506 binding protein 2, 13kDa

Gene ID: 2286

Organism: Homo sapiens

Other Aliases: FKBP-13, PPIase

Other Designations: 13 kDa FK506-binding protein; 13 kDa FKBP; FK506-binding protein 2 (13kD); FKBP-2; PPIase FKBP2; immunophilin FKBP13; peptidyl-prolyl cis-trans isomerase FKBP2; proline isomerase; rapamycin-binding protein; rotamase Nucleotide sequence (variant 1):

NCBI Reference Sequence: NM_004470.3

LOCUS   NM_004470

ACCESSION   NM_004470

(SEQ ID NO: 365)

Protein sequence (variant 1):

NCBI Reference Sequence: NP_004461.2

LOCUS   NP_004461

ACCESSION NP_004461

(SEQ ID NO: 366)

FLNC

Official Symbol: FLNC

Official Name: filamin C, gamma

Gene ID: 2318

Organism: Homo sapiens

Other Aliases: ABP-280, ABP280A, ABPA, ABPL, FLN2, MFM5, MPD4

Other Designations: ABP-280-like protein; ABP-L, gamma filamin; FLN-C; actin binding protein 280; actin-binding-like protein; filamin 2; filamin-2; filamin-C Nucleotide sequence (variant 1):

NCBI Reference Sequence: NM_001458.4

LOCUS    NM_001458

ACCESSION    NM_001458

(SEQ ID NO: 367)

Protein sequence (variant):

NCBI Reference Sequence: NP_001449.3

LOCUS    NP_001449

ACCESSION    NP_001449

(SEQ ID NO: 368)

HPX

Official Symbol: HPX

Official Name: hemopexin

Gene ID: 3263

Organism: Homo sapiens

Other Aliases: HX

Other Designations: beta-1B-glycoprotein

Nucleotide sequence:

NCBI Reference Sequence: NM_000613.2

LOCUS    NM_000613

ACCESSION   NM_000613

(SEQ ID NO: 369)

Protein sequence:

NCBI Reference Sequence: NP_000604.1

LOCUS    NP_000604

ACCESSION   NP_000604

(SEQ ID NO: 370)

TLN1

Official Symbol: TLN1

Official Name: talin 1

Gene ID: 7094

Organism: Homo sapiens

Other Aliases: RP11-112J3.1, ILWEQ, TLN

Other Designations: talin-1

Nucleotide sequence:

NCBI Reference Sequence: NM_006289.3

LOCUS    NM_006289

ACCESSION   NM_006289

(SEQ ID NO: 371)

Protein sequence:

NCBI Reference Sequence: NP_006280.3

LOCUS    NP_006280

ACCESSION    NP_006280

(SEQ ID NO: 372)

PSME2,

Official Symbol: PSME2 and Name: proteasome (prosome, macropain) activator subunit 2 (PA28 beta) [Homo sapiens]

Other Aliases: PA28B, PA28beta, REGbeta

Other Designations: 11S regulator complex beta subunit; 11S regulator complex subunit beta; MCP activator, 31-kD subunit; REG-beta; activator of multicatalytic protease subunit 2; cell migration-inducing protein 22; proteasome activator 28 subunit beta; proteasome activator 28-beta; proteasome activator complex subunit 2; proteasome activator hPA28 subunit beta

LOCUS    NM_002818

ACCESSION    NM_002818

VERSION    NM_002818.2  GI:30410791

(SEQ ID NO: 373)

LOCUS    NP_002809

ACCESSION    NP_002809

VERSION    NP_002809.2  GI:30410792

(SEQ ID NO: 374)

Q9BQE5

Official Symbol: APOL2 and Name: apolipoprotein L, 2

Other Aliases: APOL-II, APOL3

Other Designations: apolipoprotein L-II; apolipoprotein L2

LOCUS    NM_030882

ACCESSION    NM_030882

VERSION    NM_030882.2  GI:22035654

(SEQ ID NO: 375)

LOCUS    NP_112092

ACCESSION    NP_112092

VERSION    NP_112092.1  GI:13562090

(SEQ ID NO: 376)

Q9Y262

Official Symbol: EIF3L and Name: eukaryotic translation initiation factor 3, subunit L Other Aliases: AL022311.1, EIF3EIP, EIF3S11, EIF3S6IP, HSPC021, HSPC025, MSTP005

Other Designations: eIEF associated protein HSPC021; eukaryotic translation initiation factor 3 subunit 6-interacting protein; eukaryotic translation initiation factor 3 subunit E-interacting protein; eukaryotic translation initiation factor 3 subunit L

LOCUS    NM_001242923

ACCESSION    NM_001242923

VERSION    NM_001242923.1  GI:339275830

(SEQ ID NO: 377)

LOCUS    NP_001229852

ACCESSION    NP_001229852

VERSION    NP_001229852.1  GI:339275831

(SEQ ID NO: 378)

Official Symbol: RAB1B and Name: RAB1B, member RAS oncogene family [Homo sapiens]

Other Designations: ras-related protein Rab-1B; small GTP-binding protein

LOCUS    NM_030981

ACCESSION   NM_030981 XM_001134089

VERSION    NM_030981.2  GI:116014337

(SEQ ID NO: 379)

LOCUS    NP_112243

ACCESSION   NP_112243 XP_001134089

VERSION    NP_112243.1  GI:13569962

(SEQ ID NO: 380)

Official Symbol: RPS6 provided by HGNC

Official Full Name: ribosomal protein S6provided by HGNC

Also known as: S6

LOCUS    NM_001010

ACCESSION   NM_001010

VERSION    NM_001010.2  GI:17158043

(SEQ ID NO: 381)

LOCUS    NP_001001

ACCESSION   NP_001001

VERSION    NP_001001.2  GI:17158044

SEQ ID NO: 382)

Official SymbolRRP1

Official Full Nameribosomal RNA processing 1 homolog (S. cerevisiae)

Also known asNNP-1; NOP52; RRP1A; D21S2056E

LOCUS    NM_003683

ACCESSION   NM_003683

VERSION    NM_003683.5  GI:134304836

(SEQ ID NO: 383)

LOCUS    NP_003674

ACCESSION   NP_003674

VERSION    NP_003674.1  GI:4503247

(SEQ ID NO: 384)

Summary Official Symbol: SEPT11

Official Full Name: septin 11

LOCUS    NM_018243

ACCESSION   NM_018243

VERSION    NM_018243.2  GI:38605734

(SEQ ID NO: 385)

LOCUS    NP_060713

ACCESSION   NP_060713

VERSION    NP_060713.1  GI:8922712

(SEQ ID NO: 386)

Official Symbol: SEPT7 and Name: septin 7

Other Aliases: CDC10, CDC3, NBLA02942, SEPT7A

Other Designations: CDC10 (cell division cycle 10, S. cerevisiae, homolog); CDC10 protein homolog; septin-7

LOCUS    NM_001011553

ACCESSION   NM_001011553

VERSION    NM_001011553.3  GI:339639595

(SEQ ID NO: 387)

LOCUS    NP_001011553

ACCESSION   NP_001011553

(SEQ ID NO: 388)

Official Symbol: SH3BGRL and Name: SH3 domain binding glutamic acid-rich protein like [Homo sapiens]

Other Aliases: SH3BGR

Other Designations: SH3 domain-binding glutamic acid-rich-like protein; SH3-binding domain glutamic acid-rich protein like LOCUS    NM_003022    2090 bp   mRNA   linear   PRI 27-JUN-2012

ACCESSION   NM_003022

VERSION    NM_003022.2  GI:211938420

(SEQ ID NO: 389)

LOCUS    NP_003013

ACCESSION   NP_003013

VERSION    NP_003013.1  GI:4506925

(SEQ ID NO: 390)

Official Symbol: SNRPB and Name: small nuclear ribonucleoprotein polypeptides B and B1

Other Aliases: COD, SNRPB1, Sm-B/B', SmB/B', SmB/SmB', snRNP-B

Other Designations: B polypeptide of Sm protein; Sm protein B/B'; sm-B/Sm-B'; small nuclear ribonucleoprotein polypeptide B; small nuclear ribonucleoprotein polypeptides B and B'; small nuclear ribonucleoprotein-associated proteins B and B'

LOCUS    NM_003091

ACCESSION   NM_003091

VERSION    NM_003091.3  GI:38149990

(SEQ ID NO: 391)

LOCUS    NP_003082         231 aa       linear   PRI 27-JUN-2012

ACCESSION   NP_003082

VERSION    NP_003082.1  GI:4507125

(SEQ ID NO: 392)

Official Symbol: SOD1 and Name: superoxide dismutase 1, soluble

Other Aliases: ALS, ALS1, IPOA, SOD, hSod1, homodimer

Other Designations: Cu/Zn superoxide dismutase; SOD, soluble; indophenoloxidase A; superoxide dismutase [Cu-Zn]; superoxide dismutase, cystolic

LOCUS    NM_000454

ACCESSION   NM_000454

VERSION    NM_000454.4  GI:48762945

(SEQ ID NO: 393)

LOCUS    NP_000445

ACCESSION   NP_000445

VERSION    NP_000445.1  GI:4507149

(SEQ ID NO: 394)

KARS

Official Symbol: KARS

Official Name: lysyl-tRNA synthetase

Gene ID: 3735

Organism: Homo sapiens

Other Aliases: CMTRIB, KARS2, KRS

Other Designations: lysRS; lysine tRNA ligase; lysine--tRNA ligase

Nucleotide sequence:

NCBI Reference Sequence: NM_001130089.1

LOCUS: NM_001130089

ACCESSION : NM_001130089

(SEQ ID NO: 395)

//

Protein sequence:

NCBI Reference Sequence: NP_001123561.1

LOCUS: NP_001123561

ACCESSION: NP_001123561

(SEQ ID NO: 396)

//

---

KIF5B

Official Symbol: KIF5B

Official Name: kinesin family member 5B

Gene ID: 3799

Organism: Homo sapiens

Other Aliases: KINH, KNS, KNS1, UKHC

Other Designations: conventional kinesin heavy chain; kinesin 1 (110-120kD); kinesin heavy chain; kinesin-1 heavy chain; ubiquitous kinesin heavy chain Nucleotide sequence:

NCBI Reference Sequence: NM_004521.2

LOCUS: NM_004521

ACCESSION : NM_004521

(SEQ ID NO: 397)
//

Protein sequence:

NCBI Reference Sequence: NP_004512.1

LOCUS: NP_004512

ACCESSION: NP_004512

(SEQ ID NO: 398)
//

---

KPNA3

Official Symbol: KPNA3

Official Name: karyopherin alpha 3 (importin alpha 4)

Gene ID: 3839

Organism: Homo sapiens

Other Aliases: RP11-432M24.3, IPOA4, SRP1, SRP1gamma, SRP4, hSRP1

Other Designations: SRP1-gamma; importin alpha 4; importin alpha Q2; importin alpha-3; importin subunit alpha-3; importin-alpha-Q2; karyopherin subunit alpha-3; qip2

Nucleotide sequence:

NCBI Reference Sequence: NM_002267.3

LOCUS: NM_002267

ACCESSION : NM_002267

(SEQ ID NO: 399)

//

Protein sequence:

NCBI Reference Sequence: NP_002258.2

LOCUS: NP_002258

ACCESSION: NP_002258

(SEQ ID NO: 400)

//

---

LGALS1

Official Symbol: LGALS1

Official Name: lectin, galactoside-binding, soluble, 1

Gene ID: 3956

Organism: Homo sapiens

Other Aliases: GAL1, GBP

Other Designations: 14 kDa laminin-binding protein; 14 kDa lectin; HBL; HLBP14; HPL; S-Lac lectin 1; beta-galactoside-binding lectin L-14-I; beta-galactoside-binding protein 14kDa; gal-1; galaptin; galectin 1; galectin-1; lactose-binding lectin 1; putative MAPK-activating protein PM12

Nucleotide sequence:

NCBI Reference Sequence: NM_002305.3

LOCUS: NM_002305

ACCESSION : NM_002305

(SEQ ID NO: 401)

//

Protein sequence:

NCBI Reference Sequence: NP_002296.1

LOCUS: NP_002296

ACCESSION: NP_002296

(SEQ ID NO: 402)

//

---

MACF1

Official Symbol: MACF1

Official Name: microtubule-actin crosslinking factor 1

Gene ID: 23499

Organism: Homo sapiens

Other Aliases: ABP620, ACF7, MACF, OFC4

Other Designations: 620 kDa actin binding protein; actin cross-linking family protein 7; macrophin 1; microtubule-actin cross-linking factor 1; trabeculin-alpha Nucleotide sequence:

NCBI Reference Sequence: NM_012090.4

LOCUS: NM_012090

ACCESSION : NM_012090 NM_033024

(SEQ ID NO: 403)

//

Protein sequence:

> NCBI Reference Sequence: NP_036222.3
>
> LOCUS: NP_036222
>
> ACCESSION: NP_036222 NP_148984
>
> (SEQ ID NO: 404)

//

---

MAP1B

Official Symbol: MAP1B

Official Name: microtubule-associated protein 1B

Gene ID: 4131

Organism: Homo sapiens

Other Aliases: FUTSCH, MAP5

Other Designations: MAP-1B

Nucleotide sequence:

> NCBI Reference Sequence: NM_019217.1
>
> LOCUS: NM_019217
>
> ACCESSION : NM_019217 XM_001061557 XM_215469
>
> (SEQ ID NO: 405)

//

Protein sequence:

> NCBI Reference Sequence: NP_062090.1
>
> LOCUS: NP_062090

ACCESSION: NP_062090 XP_001061557 XP_215469

(SEQ ID NO: 406)
//

---

MDH1

Official Symbol: MDH1

Official Name: malate dehydrogenase 1, NAD (soluble)

Gene ID: 4190

Organism: Homo sapiens

Other Aliases: MDH-s, MDHA, MGC:1375, MOR2

Other Designations: cytosolic malate dehydrogenase; malate dehydrogenase, cytoplasmic; soluble malate dehydrogenase Nucleotide sequence:

NCBI Reference Sequence: NM_001199111.1

LOCUS: NM_001199111

ACCESSION : NM_001199111

(SEQ ID NO: 407)
//

Protein sequence:

NCBI Reference Sequence: NP_001186040.1

LOCUS: NP_001186040

ACCESSION: NP_001186040

(SEQ ID NO: 408)
//

NHP2L1

Official Symbol: NHP2L1

Official Name: HP2 non-histone chromosome protein 2-like 1 (S. cerevisiae)

Gene ID: 4809

Organism: Homo sapiens

Other Aliases: CTA-216E10.8, 15.5K, FA-1, FA1, NHPX, OTK27, SNRNP15-5, SNU13, SPAG12, SSFA1

Other Designations: NHP2-like protein 1; U4/U6.U5 tri-snRNP 15.5 kDa protein; [U4/U6.U5] tri-snRNP 15.5 kD RNA binding protein; high mobility group-like nuclear protein 2 homolog 1; non-histone chromosome protein 2-like 1; small nuclear ribonucleoprotein 15.5kDa (U4/U6.U5); sperm specific antigen 1

Nucleotide sequence:

NCBI Reference Sequence: NM_001003796.1

LOCUS: NM_001003796

ACCESSION : NM_001003796

(SEQ ID NO: 409)
//

Protein sequence:

NCBI Reference Sequence: NP_001003796.1

LOCUS: NP_001003796

ACCESSION: NP_001003796

(SEQ ID NO: 410)
//

OLA1

Official Symbol: OLA1

Official Name: Obg-like ATPase 1

Gene ID: 29789

Organism: Homo sapiens

Other Aliases: PTD004, DOC45, GBP45, GTBP9, GTPBP9

Other Designations: DNA damage-regulated overexpressed in cancer 45 protein; GTP-binding protein 9 (putative); GTP-binding protein PTD004; homologous yeast-44.2 protein; obg-like ATPase 1

Nucleotide sequence:

NCBI Reference Sequence: NM_001011708.1

LOCUS: NM_001011708

ACCESSION : NM_001011708

(SEQ ID NO: 411)
//

Protein sequence:

NCBI Reference Sequence: NP_001011708.1

LOCUS: NP_001011708

ACCESSION: NP_001011708

(SEQ ID NO: 412)
//

---

POFUT1

Official Symbol: POFUT1

Official Name: protein O-fucosyltransferase 1

Gene ID: 23509

Organism: Homo sapiens

Other Aliases: FUT12, O-FUT, O-Fuc-T, O-FucT-1

Other Designations: GDP-fucose protein O-fucosyltransferase 1; o-fucosyltransferase protein; peptide-O-fucosyltransferase 1

Nucleotide sequence:

NCBI Reference Sequence: NM_015352.1

LOCUS: NM_015352

ACCESSION : NM_015352

(SEQ ID NO: 413)
//

Protein sequence:

NCBI Reference Sequence: NP_056167.1

LOCUS: NP_056167

ACCESSION: NP_056167

(SEQ ID NO: 414)
//

---

PRKDC

Official Symbol: PRKDC

Official Name: protein kinase, DNA-activated, catalytic polypeptide

Gene ID: 5591

Organism: Homo sapiens

Other Aliases: DNA-PKcs, DNAPK, DNPK1, HYRC, HYRC1, XRCC7, p350

Other Designations: DNA-PK catalytic subunit; DNA-dependent protein kinase catalytic subunit; hyper-radiosensitivity of murine scid mutation, complementing 1; p460

Nucleotide sequence:

NCBI Reference Sequence: NM_001081640.1

LOCUS: NM_001081640

ACCESSION : NM_001081640

(SEQ ID NO: 415)
//

Protein sequence:

NCBI Reference Sequence: NP_001075109.1

LOCUS: NP_001075109

ACCESSION: NP_001075109

(SEQ ID NO: 416)
//

---

PSMD6

Official Symbol: PSMD6

Official Name: proteasome (prosome, macropain) 26S subunit, non-ATPase, 6

Gene ID: 9861

Organism: Homo sapiens

Other Aliases: Rpn7, S10, SGA-113M, p44S10

Other Designations: 26S proteasome non-ATPase regulatory subunit 6; 26S proteasome regulatory subunit RPN7; 26S proteasome regulatory subunit S10; breast cancer-associated protein SGA-113M; p42A; phosphonoformate immuno-associated protein 4; proteasome regulatory particle subunit p44S10

Nucleotide sequence:

NCBI Reference Sequence: NM_014814.1

LOCUS: NM_014814

ACCESSION : NM_014814

(SEQ ID NO: 417)
//

Protein sequence:

NCBI Reference Sequence: NP_055629.1

LOCUS: NP_055629

ACCESSION: NP_055629

(SEQ ID NO: 418)
//

ITGB1

Official Symbol: ITGB1

Official Name: integrin, beta 1 (fibronectin receptor, beta polypeptide, antigen CD29 includes MDF2, MSK12) [Homo sapiens]

Gene ID: 3688

Organism: Homo sapiens

Other Aliases: RP11-479G22.2, CD29, FNRB, GPIIA, MDF2, MSK12, VLA-BETA, VLAB

Other Designations: integrin VLA-4 beta subunit; integrin beta-1; very late activation protein, beta polypeptide Nucleotide sequence:

NCBI Reference Sequence: NM_002211.3

LOCUS: NM_002211

ACCESSION : NM_002211

(SEQ ID NO: 419)
//

Protein sequence:

NCBI Reference Sequence: NP_002202.2

LOCUS: NP_002202

ACCESSION: NP_002202

(SEQ ID NO: 420)

MYH10

Official Symbol: MYH10

Official Name: myosin, heavy chain 10, non-muscle [Homo sapiens]

Gene ID: 4628

Organism: Homo sapiens

Other Aliases: NMMHC-IIB, NMMHCB

Other Designations: cellular myosin heavy chain, type B; myosin heavy chain, nonmuscle type B; myosin, heavy polypeptide 10, non-muscle; myosin-10; nonmuscle myosin II heavy chain-B; nonmuscle myosin heavy chain IIB Nucleotide sequence:

NCBI Reference Sequence: NM_001256012.1

LOCUS: NM_001256012

ACCESSION : NM_001256012

(SEQ ID NO: 421)
//

Protein sequence:

NCBI Reference Sequence: NP_001242941.1

LOCUS: NP_001242941

ACCESSION: NP_001242941

(SEQ ID NO: 422)
//

NCL

Official Symbol: NCL

Official Name: nucleolin [Homo sapiens]

Gene ID: 4691

Organism: Homo sapiens

Other Aliases: C23

Nucleotide sequence:

NCBI Reference Sequence: NM_005381.2

LOCUS: NM_005381

ACCESSION : NM_005381 XM_002342275

(SEQ ID NO: 423)
//

Protein sequence:

NCBI Reference Sequence: NP_005372.2

LOCUS: NP_005372

ACCESSION: NP_005372 XP_002342316

(SEQ ID NO: 424)
//

SEC61A1

Official Symbol: SEC61A1

Official Name: Sec61 alpha 1 subunit (S. cerevisiae) [Homo sapiens]

Gene ID: 29927

Organism: Homo sapiens

Other Aliases: HSEC61, SEC61, SEC61A

Other Designations: Sec61 alpha-1; protein transport protein SEC61 alpha subunit; protein transport protein Sec61 subunit alpha; protein transport protein Sec61 subunit alpha isoform 1; sec61

Nucleotide sequence:

> NCBI Reference Sequence: NM_013336.3
>
> LOCUS: NM_013336
>
> ACCESSION: NM_013336 NM_015968
>
> (SEQ ID NO: 425)
> //

Protein sequence:

> NCBI Reference Sequence: NP_037468.1
>
> LOCUS: NP_037468
>
> ACCESSION: NP_037468 NP_057052
>
> (SEQ ID NO: 426)

//

PAPSS2

Official Symbol: PAPSS2

Official Name: 3'-phosphoadenosine 5'-phosphosulfate synthase 2 [Homo sapiens]

Gene ID: 9060

Organism: Homo sapiens

Other Aliases: RP11-77F13.2, ATPSK2, SK2

Other Designations: 3-prime-phosphoadenosine 5-prime-phosphosulfate synthase 2; ATP sulfurylase/APS kinase 2; ATP sulfurylase/adenosine 5'-phosphosulfate kinase; PAPS synthase 2; PAPS synthetase 2; PAPSS 2; SK 2; bifunctional 3'-phosphoadenosine 5'-phosphosulfate synthase 2; bifunctional 3'-phosphoadenosine 5'-phosphosulfate synthethase 2

Nucleotide sequence:

NCBI Reference Sequence: NM_001015880.1

LOCUS: NM_001015880

ACCESSION: NM_001015880

(SEQ ID NO: 427)
   //

Protein sequence:

NCBI Reference Sequence: NP_001015880.1

LOCUS: NP_001015880

ACCESSION: NP_001015880

(SEQ ID NO: 428)
   //

SEQUENCE LISTING (429 sequences)

SEQ ID NO: 1 - DNA, 3973 bp, Homo sapiens
gggctgggggagggtatataagccgagtaggcgacggtgaggtcgacgccggccaagacagcacagacagattgacctattggggtgtttcgcgagtgtgagagggaagcgccgcggcctgtatttctagacctgcccttcgcctggttcgtggcgccttgtgaccccgggcccctgccgcctgcaagtcggaaattgcgctgtgctcctgtgctacggcctgtggctggactgcctgctgctgcccaactggctggcaagatgaagctctccctggtggccgcgatgctgctgctgctcagcgcggcgcgggccgaggaggaggacaagaaggaggacgtgggcacggtggtcggcatcgacctggggaccacctactcctgcgtcggcgtgttcaagaacggccgcgtggagatcatcgccaacgatcagggcaaccgcatcacgccgtcctatgtcgccttcactcctgaaggggaacgtctgattggcgatgccgccaagaaccagctcacctccaaccccgagaacacggtctttgacgccaagcggctcatcggccgcacgtggaatgacccgtctgtgcagcaggacatcaagttcttgccgttcaaggtggttgaaaagaaaactaaaccatacattcaagttgatattggaggtgggcaaacaaagacatttgctcctgaagaaatttctgccatggttctcactaaaatgaaagaaaccgctgaggcttatttgggaaagaaggttacccatgcagttgttactgtaccagcctattttaatgatgcccaacgccaagcaaccaaagacgctggaactattgctggcctaaatgttatgaggatcatcaacgagcctacggcagctgctattgcttatggcctggataagagggagggggagaagaacatcctggtgtttgacctgggtggcggaaccttcgatgtgtctcttctcaccattgacaatggtgtcttcgaagttgtggccactaatggagatactcatctgggtggagaagactttgaccagcgtgtcatggaacacttcatcaaactgtacaaaaagaagacgggcaaagatgtcaggaaagacaatagagctgtgcagaaactccggcgcgaggtagaaaaggccaaacgggccctgtcttctcagcatcaagcaagaattgaaattgagtccttctatgaaggagaagacttttctgagaccctgactcgggccaaatttgaagagctcaacatggatctgttccggtctactatgaagcccgtccagaaagtgttggaagattctgatttgaagaagtctgatattgatgaaattgttcttgttggtggctcgactcgaattccaaagattcagcaactggttaaagagttcttcaatggcaaggaaccatcccgtggcataaacccagatgaagctgtagcgtatggtgctgctgtccaggctggtgtgctctctggtgatcaagatacaggtgacctggtactgcttgatgtatgtccccttacacttggtattgaaactgtgggaggtgtcatgaccaaactgattccaaggaacacagtggtgcctaccaagaagtctcagatcttttctacagcttctgataatcaaccaactgttacaatcaaggtctatgaaggtgaaagacccctgacaaaagacaatcatcttctgggtacatttgatctgactggaattcctcctgctcctcgtggggtcccacagattgaagtcacctttgagatagatgtgaatggtattcttcgagtgacagctgaagacaagggtacagggaacaaaaataagatcacaatcaccaatgaccagaatcgcctgacacctgaagaaatcgaaaggatggttaatgatgctgagaagtttgctgaggaagacaaaaagctcaaggagcgcattgatactagaaatgagttggaaagctatgcctattctctaaagaatcagattggagataaagaaaagctgggaggtaaactttcctctgaagataaggagaccatggaaaaagctgtagaagaaaagattgaatggctggaaagccaccaagatgctgacattgaagacttcaaagctaagaagaaggaactggaagaaattgttcaaccaattatcagcaaactctatggaagtgcaggccctcccccaactggtgaagaggatacagcagaaaaagatgagttgtagacactgatctgctagtgctgtaatattgtaaatactggactcaggaacttttgttaggaaaaaattgaaagaacttaagtctcgaatgtaattggaatcttcacctcagagtggagttgaaactgctatagcctaagcggctgtttactgcttttcattagcagttgctcacatgtctttgggtgggggggagaagaagaattggccatcttaaaaagcgggtaaaaaacctgggttagggtgtgtgttcaccttcaaaatgttctatttaacaactgggtcatgtgcatctggtgtaggaagttttttctaccataagtgacaccaataaatgtttgttatttacactggtctaatgtttgtgagaagcttctaattagatcaattacttattttaggaaatttaagactagatactcgtgtgtggggtgaggggagggagtatttggtatgttgggataaggaaacacttctatttaatgcttccagggatttttttttttttttttaaccctcctgggcccaagtgatccttccacctcagtctcccagctaattgagaccacaggcttgttaccaccatgctcggcttttgcattaatctaagaaaaggggagagaagttaatccacatctttactcaggcaaggggcatttcacagtgcccaagagtggggttttcttgaacatacttggtttcctatttccccttatctttctaaaactgcctttctggtggctttttttaaaattattactaatgatgcttttatagctgcttggattctctgagaaatgatggggagtgagtgatcactggtattaactttatacacttggatttcatttgtaactttaggatgtaaaggtatattgtgaaccctagctgtgtcagaatctccatccctgaaatttctcattagtggtactggggtgggatcttggatggtgacattgaaactacactaaatcccctcactatgaatgggttgttaaaggcaatggtttgtgtcaaaactggtttaggattacttagattgtgttcctgaagaaaagagtccaggtaaatggtatgatcaataaaggacaggctggtgctaacataaaatccaatattgtaatcctagcactttgggaggccaaggcgggtggatcacaaggtcaagagatagagaccatctttgccaacatggtgaaactccatctctactgaaaatacaaaaattagctgggcgtggtagtgcaagctgaaggctgaggcaggagaatcactcgaacccgggaggcagaggttgcagtgagccgagatcacaccactgtactccagcccggcactccagcctggcgacaagagtgagactccacctcaaaaaaaaaaaaaagaatccaatactgcccaaggataggtattttatagatgggcaactggctgaaaggttaattctctagggctagtagaactggatcccaacaccaaactcttaattagacctaggcctcagctgcactgcccgaaaagcatttgggcagaccctgagcagaatactggtctcaggccaagcccaatacagccattaaagatgacctacagtgctgtgtaccctggggcaatagggttaaatggtagttagcaactagggctagtcttcccttacctcaaaggctctcactaccgtggaccacctagtctgtaactctttctgaggagctgttactgaatattaaaaagatagacttcaactatgaaa

SEQ ID NO: 2 - protein, 654 aa, Homo sapiens
MKLSLVAAMLLLLSAARAEEEDKKEDVGTVVGIDLGTTYSCVGVFKNGRVEIIANDQGNRITPSYVAFTPEGERLIGDAAKNQLTSNPENTVFDAKRLIGRTWNDPSVQQDIKFLPFKVVEKKTKPYIQVDIGGGQTKTFAPEEISAMVLTKMKETAEAYLGKKVTHAVVTVPAYFNDAQRQATKDAGTIAGLNVMRIINEPTAAAIAYGLDKREGEKNILVFDLGGGTFDVSLLTIDNGVFEVVATNGDTHLGGEDFDQRVMEHFIKLYKKKTGKDVRKDNRAVQKLRREVEKAKRALSSQHQARIEIESFYEGEDFSETLTRAKFEELNMDLFRSTMKPVQKVLEDSDLKKSDIDEIVLVGGSTRIPKIQQLVKEFFNGKEPSRGINPDEAVAYGAAVQAGVLSGDQDTGDLVLLDVCPLTLGIETVGGVMTKLIPRNTVVPTKKSQIFSTASDNQPTVTIKVYEGERPLTKDNHLLGTFDLTGIPPAPRGVPQIEVTFEIDVNGILRVTAEDKGTGNKNKITITNDQNRLTPEEIERMVNDAEKFAEEDKKLKERIDTRNELESYAYSLKNQIGDKEKLGGKLSSEDKETMEKAVEEKIEWLESHQDADIEDFKAKKKELEEIVQPIISKLYGSAGPPPTGEEDTAEKDEL

SEQ ID NO: 3 - DNA, 3506 bp, Homo sapiens
ttcctcccctggactctttctgagctcagagccgccgcagccgggacaggagggcaggctttctccaaccatcatgctgcggagcatattacctgtacgccctggctccgggagcggcagtcgagtatcctctggtcaggcggcgcgggcggcgcctcagcggaagagcgggcctctgggccgcagtgaccaacccccgcccctcaccccacgtggttggaggtttccagaagcgctgccgccaccgcatcgcgcagctctttgccgtcggagcgcttgtttgctgcctcgtactcctccatttatccgccatgataagtgccagccgagctgcagcagcccgtctcgtgggcgccgcagcctcccggggccctacggccgcccgccaccaggatagctggaatggccttagtcatgaggcttttagacttgtttcaaggcgggattatgcatcagaagcaatcaagggagcagttgttggtattgatttgggtactaccaactcctgcgtggcagttatggaaggtaaacaagcaaaggtgctggagaatgccgaaggtgccagaaccaccccttcagttgtggcctttacagcagatggtgagcgacttgttggaatgccggccaagcgacaggctgtcaccaacccaaacaatacattttatgctaccaagcgtctcattggccggcgatatgatgatcctgaagtacagaaagacattaaaaatgttccctttaaaattgtccgtgcctccaatggtgatgcctgggttgaggctcatgggaaattgtattctccgagtcagattggagcatttgtgttgatgaagatgaaagagactgcagaaaattacttggggcacacagcaaaaaatgctgtgatcacagtcccagcttatttcaatgactcgcagagacaggccactaaagatgctggccagatatctggactgaatgtgcttcgggtgattaatgagcccacagctgctgctcttgcctatggtctagacaaatcagaagacaaagtcattgctgtatatgatttaggtggtggaacttttgatatttctatcctggaaattcagaaaggagtatttgaggtgaaatccacaaatggggataccttcttaggtggggaagactttgaccaggccttgctacggcacattgtgaaggagttcaagagagagacaggggttgatttgactaaagacaacatggcacttcagagggtacgggaagctgctgaaaaggctaaatgtgaactctcctcatctgtgcagactgacatcaatttgccctatcttacaatggattcttctggacccaagcatttgaatatgaagttgacccgtgctcaatttgaagggattgtcactgatctaatcagaaggactatcgctccatgccaaaaagctatgcaagatgcagaagtcagcaagagtgacataggagaagtgattcttgtgggtggcatgactaggatgcccaaggttcagcagactgtacaggatctttttggcagagccccaagtaaagctgtcaatcctgatgaggctgtggccattggagctgccattcagggaggtgtgttggccggcgatgtcacggatgtgctgctccttgatgtcactcccctgtctctgggtattgaaactctaggaggtgtctttaccaaacttattaataggaataccactattccaaccaagaagagccaggtattctctactgccgctgatggtcaaacgcaagtggaaattaaagtgtgtcagggtgaaagagagatggctggagacaacaaactccttggacagtttactttgattggaattccaccagcccctcgtggagttcctcagattgaagttacatttgacattgatgccaatgggatagtacatgtttctgctaaagataaaggcacaggacgtgagcagcagattgtaatccagtcttctggtggattaagcaaagatgatattgaaaatatggttaaaaatgcagagaaatatgctgaagaagaccggcgaaagaaggaacgagttgaagcagttaatatggctgaaggaatcattcacgacacagaaaccaagatggaagaattcaaggaccaattacctgctgatgagtgcaacaagctgaaagaagagatttccaaaatgagggagctcctggctagaaaagacagcgaaacaggagaaaatattagacaggcagcatcctctcttcagcaggcatcactgaagctgttcgaaatggcatacaaaaagatggcatctgagcgagaaggctctggaagttctggcactggggaacaaaaggaagatcaaaaggaggaaaaacagtaataatagcagaaattttgaagccagaaggacaacatatgaagcttaggagtgaagagacttcctgagcagaaatgggcgaacttcagtctttttactgtgtttttgcagtattctatatataatttccttaatttgtaaatttagtgaccattagctagtgatcatttaatggacagtgattctaacagtataaagttcacaatattctatgtccctagcctgtcatttttcagctgcatgtaaaaggaggtaggatgaattgatcattataaagatttaactattttatgctgaagtgaccatattttcaaggggtgaaaccatctcgcacacagcaatgaaggtagtcatccatagacttgaaatgagaccacatatggggatgagatccttctagttagcctagtactgctgtactggcctgtatgtacatggggtccttcaactgaggccttgcaagtcaagctggctgtgccatgtttgtagatggggcagaggaatctagaacaatgggaaacttagctatttatattaggtacagctattaaaacaaggtaggaatgaggctagacctttaacttccctaaggcatacttttctagctaccttctgccctgtgtctggcacctacatccttgatgattgttctcttacccattctggaatttttttttttttaaataaatacagaaagcatcttgatctcttgtttgtgaggggtgatgccctgagatttagcttcaagaatatgccatggctcatgcttcccatatttcccaaagagggaaatacaggatttgctaacactggttaaaaatgcaaattcaagatttggaagggctgttataatgaaataatgagcagtatcagcatgtgcaaatcttgtttgaaggattttattttctccccttagacctttggtacatttagaatcttgaaagtttctagatctctaacatgaaagtttctagatctctaacatgaaagtttttagatctctaacatgaaaaccaaggtggctattttcaggttgctttcagctccaagtagaaataaccagaattggcttacattaaagaaactgcatctagaaataagtcctaagatactatttctatggctcaaaaataaaaggaacccagatttctttcccta

SEQ ID NO: 4 - protein, 679 aa, Homo sapiens
MISASRAAAARLVGAAASRGPTAARHQDSWNGLSHEAFRLVSRRDYASEAIKGAVVGIDLGTTNSCVAVMEGKQAKVLENAEGARTTPSVVAFTADGERLVGMPAKRQAVTNPNNTFYATKRLIGRRYDDPEVQKDIKNVPFKIVRASNGDAWVEAHGKLYSPSQIGAFVLMKMKETAENYLGHTAKNAVITVPAYFNDSQRQATKDAGQISGLNVLRVINEPTAAALAYGLDKSEDKVIAVYDLGGGTFDISILEIQKGVFEVKSTNGDTFLGGEDFDQALLRHIVKEFKRETGVDLTKDNMALQRVREAAEKAKCELSSSVQTDINLPYLTMDSSGPKHLNMKLTRAQFEGIVTDLIRRTIAPCQKAMQDAEVSKSDIGEVILVGGMTRMPKVQQTVQDLFGRAPSKAVNPDEAVAIGAAIQGGVLAGDVTDVLLLDVTPLSLGIETLGGVFTKLINRNTTIPTKKSQVFSTAADGQTQVEIKVCQGEREMAGDNKLLGQFTLIGIPPAPRGVPQIEVTFDIDANGIVHVSAKDKGTGREQQIVIQSSGGLSKDDIENMVKNAEKYAEEDRRKKERVEAVNMAEGIIHDTETKMEEFKDQLPADECNKLKEEISKMRELLARKDSETGENIRQAASSLQQASLKLFEMAYKKMASEREGSGSSGTGEQKEDQKEEKQ

SEQ ID NO: 5 - DNA, 931 bp, Homo sapiens
tttcgtcggcccgccccttggcttctgcactgatggtgggtggatgagtaatgcatccaggaagcctggaggcctgtggtttccgcacccgctgccacccccgcccctagcgtggacatttatcctctagcgctcaggccctgccgccatcgccgcagatccagcgcccagagagacaccagagaacccaccatggccccctttgagcccctggcttctggcatcctgttgttgctgtggctgatagcccccagcagggcctgcacctgtgtcccaccccacccacagacggccttctgcaattccgacctcgtcatcagggccaagttcgtggggacaccagaagtcaaccagaccaccttataccagcgttatgagatcaagatgaccaagatgtataaagggttccaagccttaggggatgccgctgacatccggttcgtctacacccccgccatggagagtgtctgcggatacttccacaggtcccacaaccgcagcgaggagtttctcattgctggaaaactgcaggatggactcttgcacatcactacctgcagttttgtggctccctggaacagcctgagcttagctcagcgccggggcttcaccaagacctacactgttggctgtgaggaatgcacagtgtttccctgtttatccatcccctgcaaactgcagagtggcactcattgcttgtggacggaccagctcctccaaggctctgaaaagggcttccagtcccgtcaccttgcctgcctgcctcgggagccagggctgtgcacctggcagtccctgcggtcccagatagcctgaatcctgcccggagtggaagctgaagcctgcacagtgtccaccctgttcccactcccatctttcttccggacaatgaaataaagagttaccacccagcagaaaaaaaaaaaaaaaa

SEQ ID NO: 6 - protein, 207 aa, Homo sapiens
MAPFEPLASGILLLLWLIAPSRACTCVPPHPQTAFCNSDLVIRAKFVGTPEVNQTTLYQRYEIKMTKMYKGFQALGDAADIRFVYTPAMESVCGYFHRSHNRSEEFLIAGKLQDGLLHITTCSFVAPWNSLSLAQRRGFTKTYTVGCEECTVFPCLSIPCKLQSGTHCLWTDQLLQGSEKGFQSRHLACLPREPGLCTWQSLRSQIA

SEQ ID NO: 7 - DNA, 1955 bp, Homo sapiens
attcatccccattcaggctttcctcagcatttattaaggactctctgctccagcctctcactctcactctcctccgctcaaactcagctcacttgagagtctcctcccgccagctgtggaaagaactttgcgtctctccagcaatgcatctccttgcgattctgttttgtgctctctggtctgcagtgttggccgagaactcggatgattatgatctcatgtatgtgaatttggacaacgaaatagacaatggactccatcccactgaggaccccacgccgtgcgcctgcggtcaggagcactcggaatgggacaagctcttcatcatgctggagaactcgcagatgagagagcgcatgctgctgcaagccacggacgacgtcctgcggggcgagctgcagaggctgcgggaggagctgggccggctcgcggaaagcctggcgaggccgtgcgcgccgggggctcccgcagaggccaggctgaccagtgctctggacgagctgctgcaggcgacccgcgacgcgggccgcaggctggcgcgtatggagggcgcggaggcgcagcgcccagaggaggcggggcgcgccctggccgcggtgctagaggagctgcggcagacgcgagccgacctgcacgcggtgcagggctgggctgcccggagctggctgccggcaggttgtgaaacagctattttattcccaatgcgttccaagaagatttttggaagcgtgcatccagtgagaccaatgaggcttgagtcttttagtgcctgcatttgggtcaaagccacagatgtattaaacaaaaccatcctgttttcctatggcacaaagaggaatccatatgaaatccagctgtatctcagctaccaatccatagtgtttgtggtgggtggagaggagaacaaactggttgctgaagccatggtttccctgggaaggtggacccacctgtgcggcacctggaattcagaggaagggctcacatccttgtgggtaaatggtgaactggcggctaccactgttgagatggccacaggtcacattgttcctgagggaggaatcctgcagattggccaagaaaagaatggctgctgtgtgggtggtggctttgatgaaacattagccttctctgggagactcacaggcttcaatatctgggatagtgttcttagcaatgaagagataagagagaccggaggagcagagtcttgtcacatccgggggaatattgttgggtggggagtcacagagatccagccacatggaggagctcagtatgtttcataaatgttgtgaaactccacttgaagccaaagaaagaaactcacacttaaaacacatgccagttgggaaggtctgaaaactcagtgcataataggaacacttgagactaatgaaagagagagttgagaccaatctttatttgtactggccaaatactgaataaacagttgaaggaaagacattggaaaaagcttttgaggataatgttactagactttatgccatggtgctttcagtttaatgctgtgtctctgtcagataaactctcaaataattaaaaaggactgtattgttgaacagagggacaattgttttacttttctttggttaattttgttttggccagagatgaattttacattggaagaataacaaaataagatttgttgtccattgttcattgttattggtatgtaccttattacaaaaaaaagatgaaaacatatttatactacaaggtgacttaacaactataaatgtagtttatgtgttataatcgaatgtcacgtttttgagaagatagtcatataagttatattgcaaaagggatttgtattaatttaagactatttttgtaaagctctactgtaaataaaatattttataaaactagctcacgtcatttaattataaatttaagagatgttttggaaaaaaaaaaaaaaaaaa

SEQ ID NO: 8 - protein, 381 aa, Homo sapiens
MHLLAILFCALWSAVLAENSDDYDLMYVNLDNEIDNGLHPTEDPTPCACGQEHSEWDKLFIMLENSQMRERMLLQATDDVLRGELQRLREELGRLAESLARPCAPGAPAEARLTSALDELLQATRDAGRRLARMEGAEAQRPEEAGRALAAVLEELRQTRADLHAVQGWAARSWLPAGCETAILFPMRSKKIFGSVHPVRPMRLESFSACIWVKATDVLNKTILFSYGTKRNPYEIQLYLSYQSIVFVVGGEENKLVAEAMVSLGRWTHLCGTWNSEEGLTSLWVNGELAATTVEMATGHIVPEGGILQIGQEKNGCCVGGGFDETLAFSGRLTGFNIWDSVLSNEEIRETGGAESCHIRGNIVGWGVTEIQPHGGAQYVS

SEQ ID NO: 9 - DNA, 2664 bp, Homo sapiens
agagccagcccggaggagctagaaccttccccgcatttctttcagcagcctgagtcagaggcgggctggcctggcgtagccgcccagcctcgcggctcatgccccgatctgcccgaaccttctcccggggtcagcgccgcgccgcgccacccggctgagtcagcccgggcgggcgagaggctctcaactgggcgggaaggtgcgggaaggtgcggaaaggttcgcgaaagttcgcggcggcgggggtcgggtgaggcgcaaaaggataaaaagcccgtggaagcggagctgagcagatccgagccgggctggctgcagagaaaccgcagggagagcctcactgctgagcgcccctcgacggcggagcggcagcagcctccgtggcctccagcatccgacaagaagcttcagccatgcaggccccacgggagctcgcggtgggcatcgacctgggcaccacctactcgtgcgtgggcgtgtttcagcagggccgcgtggagatcctggccaacgaccagggcaaccgcaccacgcccagctacgtggccttcaccgacaccgagcggctggtcggggacgcggccaagagccaggcggccctgaacccccacaacaccgtgttcgatgccaagcggctgatcgggcgcaagttcgcggacaccacggtgcagtcggacatgaagcactggcccttccgggtggtgagcgagggcggcaagcccaaggtgcgcgtatgctaccgcggggaggacaagacgttctaccccgaggagatctcgtccatggtgctgagcaagatgaaggagacggccgaggcgtacctgggccagcccgtgaagcacgcagtgatcaccgtgcccgcctatttcaatgactcgcagcgccaggccaccaaggacgcgggggccatcgcggggctcaacgtgttgcggatcatcaatgagcccacggcagctgccatcgcctatgggctggaccggcggggcgcgggagagcgcaacgtgctcatttttgacctgggtgggggcaccttcgatgtgtcggttctctccattgacgctggtgtctttgaggtgaaagccactgctggagatacccacctgggaggagaggacttcgacaaccggctcgtgaaccacttcatggaagaattccggcggaagcatgggaaggacctgagcgggaacaagcgtgccctgcgcaggctgcgcacagcctgtgagcgcgccaagcgcaccctgtcctccagcacccaggccaccctggagatagactccctgttcgagggcgtggacttctacacgtccatcactcgtgcccgctttgaggaactgtgctcagacctcttccgcagcaccctggagccggtggagaaggccctgcgggatgccaagctggacaaggcccagattcatgacgtcgtcctggtggggggctccactcgcatccccaaggtgcagaagttgctgcaggacttcttcaacggcaaggagctgaacaagagcatcaaccctgatgaggctgtggcctatggggctgctgtgcaggcggccgtgttgatgggggacaaatgtgagaaagtgcaggatctcctgctgctggatgtggctcccctgtctctggggctggagacagcaggtggggtgatgaccacgctgatccagaggaacgccactatccccaccaagcagacccagactttcaccacctactcggacaaccagcctggggtcttcatccaggtgtatgagggtgagagggccatgaccaaggacaacaacctgctggggcgttttgaactcagtggcatccctcctgccccacgtggagtcccccagatagaggtgacctttgacattgatgctaatggcatcctgagcgtgacagccactgacaggagcacaggtaaggctaacaagatcaccatcaccaatgacaagggccggctgagcaaggaggaggtggagaggatggttcatgaagccgagcagtacaaggctgaggatgaggcccagagggacagagtggctgccaaaaactcgctggaggcccatgtcttccatgtgaaaggttctttgcaagaggaaagccttagggacaagattcccgaagaggacaggcgcaaaatgcaagacaagtgtcgggaagtccttgcctggctggagcacaaccagctggcagagaaggaggagtatgagcatcagaagagggagctggagcaaatctgtcgccccatcttctccaggctctatggggggcctggtgtccctgggggcagcagttgtggcactcaagcccgccagggggaccccagcaccggccccatcattgaggaggttgattgaatggcccttcgtgataagtcagctgtgactgtcagggctatgctatgggccttctagactgtcttctatgatcctgcccttcagagatgaactttccctccaaagctagaactttcttcccaggataactgaagtcttttgactttttggggggagggcggttcatcctcttctgcttcaaataaaaagtcattaatttattaaaacttgtgtggcactttaacattgctttcacctatattttgtgtactttgttacttgcatgtatgaattttgttatgtaaaatatagttatagacctaaataaaaaaaaaaaaaa

SEQ ID NO: 10 - protein, 643 aa, Homo sapiens
MQAPRELAVGIDLGTTYSCVGVFQQGRVEILANDQGNRTTPSYVAFTDTERLVGDAAKSQAALNPHNTVFDAKRLIGRKFADTTVQSDMKHWPFRVVSEGGKPKVRVCYRGEDKTFYPEEISSMVLSKMKETAEAYLGQPVKHAVITVPAYFNDSQRQATKDAGAIAGLNVLRIINEPTAAAIAYGLDRRGAGERNVLIFDLGGGTFDVSVLSIDAGVFEVKATAGDTHLGGEDFDNRLVNHFMEEFRRKHGKDLSGNKRALRRLRTACERAKRTLSSSTQATLEIDSLFEGVDFYTSITRARFEELCSDLFRSTLEPVEKALRDAKLDKAQIHDVVLVGGSTRIPKVQKLLQDFFNGKELNKSINPDEAVAYGAAVQAAVLMGDKCEKVQDLLLLDVAPLSLGLETAGGVMTTLIQRNATIPTKQTQTFTTYSDNQPGVFIQVYEGERAMTKDNNLLGRFELSGIPPAPRGVPQIEVTFDIDANGILSVTATDRSTGKANKITITNDKGRLSKEEVERMVHEAEQYKAEDEAQRDRVAAKNSLEAHVFHVKGSLQEESLRDKIPEEDRRKMQDKCREVLAWLEHNQLAEKEEYEHQKRELEQICRPIFSRLYGGPGVPGGSSCGTQARQGDPSTGPIIEEVD

SEQ ID NO: 11 - DNA, 2970 bp, Homo sapiens
gttttaaacgcgcagccgagggccgcgcgcaggagtagggagggcctagggcggcggagccgactcgtcgcggccgaggcgcgcgcggtccgtgccggcgtcagtctgggattggccggcccgcgacttcctccgccccctgccaatcgccggggacgacttccgtgggtttttccggctcccccgcgtcgctaaggagcgacgggctgtcggccagaccccgagttctcggtgcgctcagcggccgccgacgctaggaggccgcgctccgcccccgctaccatgaggccccggaaagccttcctgctcctgctgctcttggggctggtgcagctgctggccgtggcgggtgccgagggcccggacgaggattcttctaacagagaaaatgccattgaggatgaagaggaggaggaggaggaagatgatgatgaggaagaagacgacttggaagttaaggaagaaaatggagtcttggtcctaaatgatgcaaactttgataattttgtggctgacaaagacacagtgctgctggagttttatgctccatggtgtggacattgcaagcagtttgctccggaatatgaaaaaattgccaacatattaaaggataaagatcctcccattcctgttgccaagatcgatgcaacctcagcgtctgtgctggccagcaggtttgatgtgagtggctaccccaccatcaagatccttaagaaggggcaggctgtagactacgagggctccagaacccaggaagaaattgttgccaaggtcagagaagtctcccagcccgactggacgcctccaccagaagtcacgcttgtgttgaccaaagagaactttgatgaagttgtgaatgatgcagatatcattctggtggagttttatgccccatggtgtggacactgcaagaaacttgcccccgagtatgagaaggccgccaaggagctcagcaagcgttctcctccaattcccctggcaaaggtcgacgccaccgcagaaacagacctggccaagaggtttgatgtctctggctatcccaccctgaaaattttccgcaaaggaaggccttatgactacaacggcccacgagaaaaatatggaatcgttgattacatgatcgagcagtccgggcctccctccaaggagattctgaccctgaagcaggtccaggagttcctgaaggatggagacgatgtcatcatcatcggggtctttaagggggagagtgacccagcctaccagcaataccaggatgccgctaacaacctgagagaagattacaaatttcaccacactttcagcacagaaatagcaaagttcttgaaagtctcccaggggcagttggttgtaatgcagcctgagaaattccagtccaagtatgagccccggagccacatgatggacgtccagggctccacccaggactcggccatcaaggacttcgtgctgaagtacgccctgcccctggttggccaccgcaaggtgtcaaacgatgctaagcgctacaccaggcgccccctggtggtcgtctactacagtgtggacttcagctttgattacagagctgcaactcagttttggcggagcaaagtcctagaggtggccaaggacttccctgagtacacctttgccattgcggacgaagaggactatgctggggaggtgaaggacctggggctcagcgagagtggggaggatgtcaatgccgccatcctggacgagagtgggaagaagttcgccatggagccagaggagtttgactctgacaccctccgcgagtttgtcactgctttcaaaaaaggaaaactgaagccagtcatcaaatcccagccagtgcccaagaacaacaagggacccgtcaaggtcgtggtgggaaagacctttgactccattgtgatggaccccaagaaggacgtcctcatcgagttctacgcgccatggtgcgggcactgcaagcagctagagcccgtgtacaacagcctggccaagaagtacaagggccaaaagggcctggtcatcgccaagatggacgccactgccaacgacgtccccagcgaccgctataaggtggagggcttccccaccatctacttcgcccccagtggggacaaaaagaacccagttaaatttgagggtggagacagagatctggagcatttgagcaagtttatagaagaacatgccacaaaactgagcaggaccaaggaagagctttgaaggcctgaggtctgcggaaggtgggaggaggcagacgccctgcgtggcccatggtcggggcgtccacgccgaggccggcaacaaacgacagtatctcggattcctttttttttttttttaattttttatactttggtgtttcacttcatgctctgaatactgaataaccatgaatgactgaatagtttagtccagatttttacagaggatacatctatttttatcattatttggggtttgaaaaatttttttttacaccttctaatttctttatttctcaaagcagataattcttctgtgtgaaaatgttttctttttttaatttaaggtttaaaattccttttccaaatcatgttgattttgctctttgctttttcgttgtctgagaaattgttggcgtagatttggcttctggtatgtgtttctgattgcttcctgttgagcacaaagtgagagctgccactgagcagccctgccaggggtgctgtttcaggctgggcatcgccaggcggcctccctgcaaaccaagggctgggggcaaaggggcatgatccagggtcccccagggtgggctcagctccagggagaggccacccacgtggcagccccacctcttgagagcccccagtgccggagcagaaaggaccctggacccagaggcagatactgcggggtggtagaaaaggtagagtaggctgtggcaatggaataaaacacgattaaaaacgttaaaaaaaaaaaaaaaaaaaa

SEQ ID NO: 12 - protein, 645 aa, Homo sapiens
MRPRKAFLLLLLLGLVQLLAVAGAEGPDEDSSNRENAIEDEEEEEEEDDDEEEDDLEVKEENGVLVLNDANFDNFVADKDTVLLEFYAPWCGHCKQFAPEYEKIANILKDKDPPIPVAKIDATSASVLASRFDVSGYPTIKILKKGQAVDYEGSRTQEEIVAKVREVSQPDWTPPPEVTLVLTKENFDEVVNDADIILVEFYAPWCGHCKKLAPEYEKAAKELSKRSPPIPLAKVDATAETDLAKRFDVSGYPTLKIFRKGRPYDYNGPREKYGIVDYMIEQSGPPSKEILTLKQVQEFLKDGDDVIIIGVFKGESDPAYQQYQDAANNLREDYKFHHTFSTEIAKFLKVSQGQLVVMQPEKFQSKYEPRSHMMDVQGSTQDSAIKDFVLKYALPLVGHRKVSNDAKRYTRRPLVVVYYSVDFSFDYRAATQFWRSKVLEVAKDFPEYTFAIADEEDYAGEVKDLGLSESGEDVNAAILDESGKKFAMEPEEFDSDTLREFVTAFKKGKLKPVIKSQPVPKNNKGPVKVVVGKTFDSIVMDPKKDVLIEFYAPWCGHCKQLEPVYNSLAKKYKGQKGLVIAKMDATANDVPSDRYKVEGFPTIYFAPSGDKKNPVKFEGGDRDLEHLSKFIEEHATKLSRTKEEL

SEQ ID NO: 13 - DNA, 2596 bp, Homo sapiens
gagcctcgaagtccgccggccaatcgaaggcgggccccagcggcgcgtgcgcgccgcggccagcgcgcgcgggcgggggggcaggcgcgccccggacccaggatttataaaggcgaggccgggaccggcgcgcgctctcgtcgcccccgctgtcccggcggcgccaaccgaagcgccccgcctgatccgtgtccgacatgctgcgccgcgctctgctgtgcctggccgtggccgccctggtgcgcgccgacgcccccgaggaggaggaccacgtcctggtgctgcggaaaagcaacttcgcggaggcgctggcggcccacaagtacctgctggtggagttctatgccccttggtgtggccactgcaaggctctggcccctgagtatgccaaagccgctgggaagctgaaggcagaaggttccgagatcaggttggccaaggtggacgccacggaggagtctgacctggcccagcagtacggcgtgcgcggctatcccaccatcaagttcttcaggaatggagacacggcttcccccaaggaatatacagctggcagagaggctgatgacatcgtgaactggctgaagaagcgcacgggcccggctgccaccaccctgcctgacggcgcagctgcagagtccttggtggagtccagcgaggtggctgtcatcggcttcttcaaggacgtggagtcggactctgccaagcagtttttgcaggcagcagaggccatcgatgacataccatttgggatcacttccaacagtgacgtgttctccaaataccagctcgacaaagatggggttgtcctctttaagaagtttgatgaaggccggaacaactttgaaggggaggtcaccaaggagaacctgctggactttatcaaacacaaccagctgccccttgtcatcgagttcaccgagcagacagccccgaagatttttggaggtgaaatcaagactcacatcctgctgttcttgcccaagagtgtgtctgactatgacggcaaactgagcaacttcaaaacagcagccgagagcttcaagggcaagatcctgttcatcttcatcgacagcgaccacaccgacaaccagcgcatcctcgagttctttggcctgaagaaggaagagtgcccggccgtgcgcctcatcaccctggaggaggagatgaccaagtacaagcccgaatcggaggagctgacggcagagaggatcacagagttctgccaccgcttcctggagggcaaaatcaagccccacctgatgagccaggagctgccggaggactgggacaagcagcctgtcaaggtgcttgttgggaagaactttgaagacgtggcttttgatgagaaaaaaaacgtctttgtggagttctatgccccatggtgtggtcactgcaaacagttggctcccatttgggataaactgggagagacgtacaaggaccatgagaacatcgtcatcgccaagatggactcgactgccaacgaggtggaggccgtcaaagtgcacagcttccccacactcaagttctttcctgccagtgccgacaggacggtcattgattacaacggggaacgcacgctggatggttttaagaaattcctggagagcggtggccaggatggggcaggggatgatgacgatctcgaggacctggaagaagcagaggagccagacatggaggaagacgatgatcagaaagctgtgaaagatgaactgtaatacgcaaagccagacccgggcgctgccgagacccctcgggggctgcacacccagcagcagcgcacgcctccgaagcctgcggcctcgcttgaaggagggcgtcgccggaaacccagggaacctctctgaagtgacacctcacccctacacaccgtccgttcacccccgtctcttccttctgcttttcggtttttggaaagggatccatctccaggcagcccaccctggtggggcttgtttcctgaaaccatgatgtactttttcatacatgagtctgtccagagtgcttgctaccgtgttcggagtctcgctgcctccctcccgcgggaggtttctcctctttttgaaaattccgtctgtgggatttttagacatttttcgacatcagggtatttgttccaccttggccaggcctcctcggagaagcttgtcccccgtgtgggagggacggagccggactggacatggtcactcagtaccgcctgcagtgtcgccatgactgatcatggctcttgcatttttgggtaaatggagacttccggatcctgtcagggtgtcccccatgcctggaagaggagctggtggctgccagccctggggcccggcacaggcctgggccttccccttccctcaagccagggctcctcctcctgtcgtgggctcattgtgaccactggcctctctacagcacggcctgtggcctgttcaaggcagaaccacgacccttgactcccgggtggggaggtggccaaggatgctggagctgaatcagacgctgacagttcttcaggcatttctatttcacaatcgaattgaacacattggccaaataaagttgaaattttaccacctgtaaaaaaaaaaaaaaaaaa

SEQ ID NO: 14 - protein, 508 aa, Homo sapiens
MLRRALLCLAVAALVRADAPEEEDHVLVLRKSNFAEALAAHKYLLVEFYAPWCGHCKALAPEYAKAAGKLKAEGSEIRLAKVDATEESDLAQQYGVRGYPTIKFFRNGDTASPKEYTAGREADDIVNWLKKRTGPAATTLPDGAAAESLVESSEVAVIGFFKDVESDSAKQFLQAAEAIDDIPFGITSNSDVFSKYQLDKDGVVLFKKFDEGRNNFEGEVTKENLLDFIKHNQLPLVIEFTEQTAPKIFGGEIKTHILLFLPKSVSDYDGKLSNFKTAAESFKGKILFIFIDSDHTDNQRILEFFGLKKEECPAVRLITLEEEMTKYKPESEELTAERITEFCHRFLEGKIKPHLMSQELPEDWDKQPVKVLVGKNFEDVAFDEKKNVFVEFYAPWCGHCKQLAPIWDKLGETYKDHENIVIAKMDSTANEVEAVKVHSFPTLKFFPASADRTVIDYNGERTLDGFKKFLESGGQDGAGDDDDLEDLEEAEEPDMEEDDDQKAVKDEL

SEQ ID NO: 15 - DNA, 3822 bp, Homo sapiens
cggcggaggcaaggcggccgcggcgcggagcagccgacgcacgctagtgggtccgcccgccaccgccccttcctcggcgtccgctcccgcccttgccgtcccccgcgcggctccgcgcctcgggccccgggcgcagccagccctccagacgcccgcggtcccggcggcgtgtgctgctcttcctccgcccgcggtttccagcgccgctccttcccccgcttgggcagggagggggcattgatcttcgatcgcgaagatggctgctggctgcctgctggccttgactctgacacttttccaatctttgctcatcggcccctcgtcggaggagccgttcccttcggccgtcactatcaaatcatgggtggataagatgcaagaagaccttgtcacactggcaaaaacagcaagtggagtcaatcagcttgttgatatttatgagaaatatcaagatttgtatactgtggaaccaaataatgcacgccagctggtagaaattgcagccagggatattgagaaacttctgagcaacagatctaaagccctggtgcgcctggcattggaagcggagaaagttcaagcagctcaccagtggagagaagattttgcaagcaatgaagttgtctactacaatgcaaaggatgatctcgatcctgagaaaaatgacagtgagccaggcagccagaggataaaacctgttttcattgaagatgctaattttggacgacaaatatcttatcagcacgcagcagtccatattcctactgacatctatgagggctcaacaattgtgttaaatgaactcaactggacaagtgccttagatgaagttttcaaaaagaatcgcgaggaagacccttcattattgtggcaggtttttggcagtgccactggcctagctcgatattatccagcttcaccatgggttgataatagtagaactccaaataagattgacctttatgatgtacgcagaagaccatggtacatccaaggagctgcatctcctaaagacatgcttattctggtggatgtgagtggaagtgttagtggattgacacttaaactgatccgaacatctgtctccgaaatgttagaaaccctctcagatgatgatttcgtgaatgtagcttcatttaacagcaatgctcaggatgtaagctgttttcagcaccttgtccaagcaaatgtaagaaataaaaaagtgttgaaagacgcggtgaataatatcacagccaaaggaattacagattataagaagggctttagttttgcttttgaacagctgcttaattataatgtttccagagcaaactgcaataagattattatgctattcacggatggaggagaagagagagcccaggagatatttaacaaatacaataaagataaaaaagtacgtgtattcacgttttcagttggtcaacacaattatgacagaggacctattcagtggatggcctgtgaaaacaaaggttattattatgaaattccttccattggtgcaataagaatcaatactcaggaatatttggatgttttgggaagaccaatggttttagcaggagacaaagctaagcaagtccaatggacaaatgtgtacctggatgcattggaactgggacttgtcattactggaactcttccggtcttcaacataaccggccaatttgaaaataagacaaacttaaagaaccagctgattcttggtgtgatgggagtagatgtgtctttggaagatattaaaagactgacaccacgttttacactgtgccccaatgggtattactttgcaatcgatcctaatggttatgttttattacatccaaatcttcagccaaagaaccccaaatctcaggagccagtaacattggatttccttgatgcagagttagagaatgatattaaagtggagattcgaaataagatgattgatggggaaagtggagaaaaaacattcagaactctggttaaatctcaagatgagagatatattgacaaaggaaacaggacatacacatggacacctgtcaatggcacagattacagtttggccttggtattaccaacctacagtttttactatataaaagccaaactagaagagacaataactcaggccagatcaaaaaagggcaaaatgaaggattcggaaaccctgaagccagataattttgaagaatctggctatacattcatagcaccaagagattactgcaatgacctgaaaatatcggataataacactgaatttcttttaaatttcaacgagtttattgatagaaaaactccaaacaacccatcatgtaacgcggatttgattaatagagtcttgcttgatgcaggctttacaaatgaacttgtccaaaattactggagtaagcagaaaaatatcaagggagtgaaagcacgatttgttgtgactgatggtgggattaccagagtttatcccaaagaggctggagaaaattggcaagaaaacccagagacatatgaggacagcttctataaaaggagcctagataatgataactatgttttcactgctccctactttaacaaaagtggacctggtgcctatgaatcgggcattatggtaagcaaagctgtagaaatatatattcaagggaaacttcttaaacctgcagttgttggaattaaaattgatgtaaattcctggatagagaatttcaccaaaacctcaatcagagatccgtgtgctggtccagtttgtgactgcaaaagaaacagtgacgtaatggattgtgtgattctggatgatggtgggtttcttctgatggcaaatcatgatgattatactaatcagattggaagattttttggagagattgatcccagcttgatgagacacctggttaatatatcagtttatgcttttaacaaatcttatgattatcagtcagtatgtgagcccggtgctgcaccaaaacaaggagcaggacatcgctcagcatatgtgccatcagtagcagacatattacaaattggctggtgggccactgctgctgcctggtctattctacagcagtttctcttgagtttgacctttccacgactccttgaggcagttgagatggaggatgatgacttcacggcctccctgtccaagcagagctgcattactgaacaaacccagtatttcttcgataacgacagtaaatcattcagtggtgtattagactgtggaaactgttccagaatctttcatggagaaaagcttatgaacaccaacttaatattcataatggttgagagcaaagggacatgtccatgtgacacacgactgctcatacaagcggagcagacttctgacggtccaaatccttgtgacatggttaagcaacccagataccgaaaagggcctgatgtctgctttgataacaatgtcttggaggattatactgactgtggtggtgtttctggattaaatccctccctgtggtatatcattggaatccagtttctactactttggctggtatctggcagcacacaccgcctgttatgaccttctaaaaaccaaatctgcatagttaaactccagaccctgccaaaacatgagccctgccctcaattacagtaacgtagggtcagctataaaatcagacaaacattagctgggcctgttccatggcataacactaaggcgcagactcctaaggcacccactggctgcatgtcagggtgtcagatccttaaacgtgtgtgaatgctgcatcatctatgtgtaacatcaaagcaaaatcctatacgtgtcctctattggaaaatttgggagtttgttgttgcattgttggt

SEQ ID NO: 16 - protein, 1091 aa, Homo sapiens
MAAGCLLALTLTLFQSLLIGPSSEEPFPSAVTIKSWVDKMQEDLVTLAKTASGVNQLVDIYEKYQDLYTVEPNNARQLVEIAARDIEKLLSNRSKALVRLALEAEKVQAAHQWREDFASNEVVYYNAKDDLDPEKNDSEPGSQRIKPVFIEDANFGRQISYQHAAVHIPTDIYEGSTIVLNELNWTSALDEVFKKNREEDPSLLWQVFGSATGLARYYPASPWVDNSRTPNKIDLYDVRRRPWYIQGAASPKDMLILVDVSGSVSGLTLKLIRTSVSEMLETLSDDDFVNVASFNSNAQDVSCFQHLVQANVRNKKVLKDAVNNITAKGITDYKKGFSFAFEQLLNYNVSRANCNKIIMLFTDGGEERAQEIFNKYNKDKKVRVFTFSVGQHNYDRGPIQWMACENKGYYYEIPSIGAIRINTQEYLDVLGRPMVLAGDKAKQVQWTNVYLDALELGLVITGTLPVFNITGQFENKTNLKNQLILGVMGVDVSLEDIKRLTPRFTLCPNGYYFAIDPNGYVLLHPNLQPKNPKSQEPVTLDFLDAELENDIKVEIRNKMIDGESGEKTFRTLVKSQDERYIDKGNRTYTWTPVNGTDYSLALVLPTYSFYYIKAKLEETITQARSKKGKMKDSETLKPDNFEESGYTFIAPRDYCNDLKISDNNTEFLLNFNEFIDRKTPNNPSCNADLINRVLLDAGFTNELVQNYWSKQKNIKGVKARFVVTDGGITRVYPKEAGENWQENPETYEDSFYKRSLDNDNYVFTAPYFNKSGPGAYESGIMVSKAVEIYIQGKLLKPAVVGIKIDVNSWIENFTKTSIRDPCAGPVCDCKRNSDVMDCVILDDGGFLLMANHDDYTNQIGRFFGEIDPSLMRHLVNISVYAFNKSYDYQSVCEPGAAPKQGAGHRSAYVPSVADILQIGWWATAAAWSILQQFLLSLTFPRLLEAVEMEDDDFTASLSKQSCITEQTQYFFDNDSKSFSGVLDCGNCSRIFHGEKLMNTNLIFIMVESKGTCPCDTRLLIQAEQTSDGPNPCDMVKQPRYRKGPDVCFDNNVLEDYTDCGGVSGLNPSLWYIIGIQFLLLWLVSGSTHRLL

SEQ ID NO: 17 - DNA, 6406 bp, Homo sapiens
tgcgtcatcagggtgcgccactgcagctggcattggccgggactggaagtgcgggcttctgcagcagccgaagctggagctgctagggcagcagcggctcccctgttgtatggacattctgcacccgaaactgatagctgagtcctgaagttttatgttatgaaacagaagaactttcatcccagcacatgatttgggaattacactttgtgacatggatgaatctgcactgacccttggtacaatagatgtttcttatctgccacattcatcagaatacagtgttggtcgatgtaagcacacaagtgaggaatggggtgagtgtggctttagacccaccatcttcagatctgcaactttaaaatggaaagaaagcctaatgagtcggaaaaggccatttgttggaagatgttgttactcctgcactccccagagctgggacaaatttttcaaccccagtatcccgtctttgggtttgcggaatgttatttatatcaatgaaactcacacaagacaccgcggatggcttgcaagacgcctttcttacgttctttttattcaagagcgagatgtgcataagggcatgtttgccaccaatgtgactgaaaatgtgctgaacagcagtagagtacaagaggcaattgcagaagtggctgctgaattaaaccctgatggttctgcccagcagcaatcaaaagccgttaacaaagtgaaaaagaaagctaaaaggattcttcaagaaatggttgccactgtctcaccggcaatgatcagactgactgggtgggtgctgctaaaactgttcaacagcttcttttggaacattcaaattcacaaaggtcaacttgagatggttaaagctgcaactgagacgaatttgccgcttctgtttctaccagttcatagatcccatattgactatctgctgctcactttcattctcttctgccataacatcaaagcaccatacattgcttcaggcaataatctcaacatcccaatcttcagtaccttgatccataagcttgggggcttcttcatacgacgaaggctcgatgaaacaccagatggacggaaagatgttctctatagagctttgctccatgggcatatagttgaattacttcgacagcagcaattcttggagatcttcctggaaggcacacgttctaggagtggaaaaacctcttgtgctcgggcaggacttttgtcagttgtggtagatactctgtctaccaatgtcatcccagacatcttgataatacctgttggaatctcctatgatcgcattatcgaaggtcactacaatggtgaacaactgggcaaacctaagaagaatgagagcctgtggagtgtagcaagaggtgttattagaatgttacgaaaaaactatggttgtgtccgagtggattttgcacagccattttccttaaaggaatatttagaaagccaaagtcagaaaccggtgtctgctctactttccctggagcaagcgttgttaccagctatacttccttcaagacccagtgatgctgctgatgaaggtagagacacgtccattaatgagtccagaaatgcaacagatgaatccctacgaaggaggttgattgcaaatctggctgagcatattctattcactgctagcaagtcctgtgccattatgtccacacacattgtggcttgcctgctcctctacagacacaggcagggaattgatctctccacattggtcgaagacttctttgtgatgaaagaggaagtcctggctcgtgattttgacctggggttctcaggaaattcagaagatgtagtaatgcatgccatacagctgctgggaaattgtgtcacaatcacccacactagcaggaacgatgagttttttatcacccccagcacaactgtcccatcagtcttcgaactcaacttctacagcaatggggtacttcatgtctttatcatggaggccatcatagcttgcagcctttatgcagttctgaacaagaggggactggggggtcccactagcaccccacctaacctgatcagccaggagcagctggtgcggaaggcggccagcctgtgctaccttctctccaatgaaggcaccatctcactgccttgccagacattttaccaagtctgccatgaaacagtaggaaagtttatccagtatggcattcttacagtggcagagcacgatgaccaggaagatatcagtcctagtcttgctgagcagcagtgggacaagaagcttccagaacctttgtcttggagaagtgatgaagaagatgaagacagtgactttggggaggaacagcgagattgctacctgaaggtgagccaatccaaggagcaccagcagtttatcaccttcttacagagactccttgggcctttgctggaggcctacagctctgctgccatctttgttcacaacttcagtggtcctgttccagaacctgagtatctgcaaaagttgcacaaatacctaataaccagaacagaaagaaatgttgcagtatatgctgagagtgccacatattgtcttgtgaagaatgctgtgaaaatgtttaaggatattggggttttcaaggagaccaaacaaaagagagtgtctgttttagaactgagcagcacttttctacctcaatgcaaccgacaaaaacttctagaatatattctgagttttgtggtgctgtaggtaacgtgtggcactgctggcaaatgaaggtcatgagatgagttccttgtaggtaccagcttctggctcaagagttgaaggtgccatcgcagggtcaggcctgccctgtcccgaagtgatctcctggaagacaagtgccttctccctccatggatctgtgatcttcccagctctgcatcaacacagcagcctgcagataacacttggggggacctcagcctctattcgcaactcataatccgtagactacaagatgaaatctcaataaattatttttgagtttattaaagattgacattttaagtacaacttttaaggactaattactgtgatggacacagaaatgtagctgtgttctggaactgaatcttacatggtatacttagtgctgctgggtaatttgttggtatattatctggttagtggttaatgcttcctttaaaaataattgagtcatccattcactctttttcagttttatctgtcaatagtagctacatttttaatgggagcaccttttatcccaaagtgctttataaattgagtggactgatatatatcacacccaggtatcactgtgctgtcctttgctgtcagatttagaaatgtttttaagagctatgtgaaaacagacaatattagtttaggtcgggaactgagatattgtaatcaaatagttaacatcaggaagttaatttggctggcaaaattctagggaaacttggccagaaaactggtgttgaaggcttttgctcatataaacaagtgccattgagtttcaaatgaccagcaaatatatttagaacccttcctgttttatgtctgtacctcgtccacccctcaggtaatacctgcctctcacaggtacagctgtttcttggaaatcctccaaccaaatagcagttttcctaacttgattagcttgagctgacagactgttagaatacagttctctggccacagctgatgagggctttctgtactgcacacagattgtgtactgcaccccagtccaggtgactggtacccactcgagttgtgccgtgcacaacctgtccagtatatgcatgtggtggccctactgactggtaatggttagaggcatttatggatttttagctttgaggaaaaaccatgacttttaacaaatttttatgggttatatgcctaaacccttatgccacatagtggtaaataattatgaaaaatggtctgttcataattggtaggtgccttttgtgagcagggagcataattattggtttattatggtaattatggtgattttttaaatatcatgtaatgttaaaacgttttctaacagtttactgttgcttatctccaagatattatggaattaagaatttttccagatgagtgttacatagattctttgaatttagtataaaagtactgagaattaagtttgtacttccataagcttggattttaaacactgatagtatctcatgagtaatgtgtgttttgggagagggagggatgctgattgatatttcacattgtatgaaataccatgtttgaaactcatagcaataatgctatgctgttgtgatccctctcaagttctgcatttaaaatatattttttctttataggaattgatgtataccatgaagtcattgtcagttgtagtagctctgatgttgaatgagatatcatgttttagcattccattttactgactagggtagaagaacacttttcttggctacatttggaggatacccagggagtcttgggtgttccttatctggggaagcaaacatttcactagtctctttttttcatcctttaaattgtaaattaaggattactcaagctcaccattattcaagattgggactcgcttcccagtcgacactctgccctgcctgtcattgctgcaaagagctgctgctttgccaacctaagcaaagaaaatacggcttctcttgcattattttcccttttggttggtttgttttctagaagtacgttcagatgctttggggaatgcaatgtatgatttgctagctctctcaccacttaactcactgtgaggataaatatgcatgctttttgtaattaactggtgctttgaaaatcttttttaagggagaaaaatctcaaccaaagttatgctcatccagacaagctgacctttgagttaatttcagcacaactcattcttcagtgcctcatgactgaaaacaaaaaacaaaaaaacgaaagcatcttcacaatgaagcttccagatagcaccgttttgctaaaagatacattctcattgttttccaacagtgatggcttccacataaggttaaacaaactaggtgcttgtaaataatttattacagtttactctatcgcatttctgtaacatgaaatgcatgcccttcttcaggggaagactgtggtcaagttaaaaaaaaaaaacaatattaaacaacatgaaactgcagtctgtttttgaaaatgagaatgtcctaagtgattcagaagagaggagggaagttgtgcactctgaaaatgcatgaaaaacaaaggcaaaaactagtgggaaatgtgtagaactgttaactgagatggcttcgagtcttccttctggaatctgttaaatttcacaaagtcatgagggtaaatggagaaaatatttctgggattacaatgaatgtaagcccaaattgtggaattgccagtaacctggatggggaaaagcatttcccatagcactccatgtaatatgagtgctctgtgagatgttcatcagtgttttatagaaatggtgttgctgggaaaccaagtttgcacctggaaacttacaatgcactttagcgcagtaagggcttggcatccggtagtgaaaaactgtctaacccagcattgcccaaactattttgacaccaggacctttttctcctttgggatacttatgaacctctcactaatgtcctgtggagaacattttgggaaacactatgttagatagttctttaaggagacaaaacggtaatgaacagatagcactggggcagaatatgcatgcattttgtaacgtccagtgtggcgttgaatagatgtgtatttcctcccctgcagaaaataagcacagaaaattataatgtaggtgatcggagctctttcctttgatagagagaacagccccaatgatcctggctttttcactgaacgtatcagaatacatggatgaattggggtaaataaggttttaattcagatctagaagaaagtattgtacgtttgaatgcagatttttatccacagatagttgtagtgtttagacatgacaggacctatcgttgaggtttctaagacttactatgggctgtaaacctgttttttaaaactattttagaaacctgagacttgccgtctggcattttagtttaatacaaactaatgattgcatttgaaagagattcttgaccttatttctaaacgtctagagctctgaaatgtcttgatggaaggtattaaactatttgcctgttgtacaaagaaatgttaagactcgtgaaaagaattactataaggtactgtgaaataactgcgattttgtgagcaaaacatacttggaaatgctgattgatttttatgcttgttagtgtattgcaagaaacacagaaaatgtagttttgttttaataaaccaaaaattgaacatacaaaaaaaaaaaaaaaaaaa

SEQ ID NO: 18 - protein, 828 aa, Homo sapiens
MDESALTLGTIDVSYLPHSSEYSVGRCKHTSEEWGECGFRPTIFRSATLKWKESLMSRKRPFVGRCCYSCTPQSWDKFFNPSIPSLGLRNVIYINETHTRHRGWLARRLSYVLFIQERDVHKGMFATNVTENVLNSSRVQEAIAEVAAELNPDGSAQQQSKAVNKVKKKAKRILQEMVATVSPAMIRLTGWVLLKLFNSFFWNIQIHKGQLEMVKAATETNLPLLFLPVHRSHIDYLLLTFILFCHNIKAPYIASGNNLNIPIFSTLIHKLGGFFIRRRLDETPDGRKDVLYRALLHGHIVELLRQQQFLEIFLEGTRSRSGKTSCARAGLLSVVVDTLSTNVIPDILIIPVGISYDRIIEGHYNGEQLGKPKKNESLWSVARGVIRMLRKNYGCVRVDFAQPFSLKEYLESQSQKPVSALLSLEQALLPAILPSRPSDAADEGRDTSINESRNATDESLRRRLIANLAEHILFTASKSCAIMSTHIVACLLLYRHRQGIDLSTLVEDFFVMKEEVLARDFDLGFSGNSEDVVMHAIQLLGNCVTITHTSRNDEFFITPSTTVPSVFELNFYSNGVLHVFIMEAIIACSLYAVLNKRGLGGPTSTPPNLISQEQLVRKAASLCYLLSNEGTISLPCQTFYQVCHETVGKFIQYGILTVAEHDDQEDISPSLAEQQWDKKLPEPLSWRSDEEDEDSDFGEEQRDCYLKVSQSKEHQQFITFLQRLLGPLLEAYSSAAIFVHNFSGPVPEPEYLQKLHKYLITRTERNVAVYAESATYCLVKNAVKMFKDIGVFKETKQKRVSVLELSSTFLPQCNRQKLLEYILSFVVL

SEQ ID NO: 19 - DNA, 1919 bp, Homo sapiens
tttccggcggttgcaccgggccggggtgccagcgcccgccttcccgtttcctcccgttccgcagcgcgcccacggcctgtgaccccggcgaccgctccccagtgacgagagagcggggccgggcgctgctccggcctgacctgcgaagggacctcggtccagtcccctgttgcgccgcgccccctgtccgtccgtgcgcgggccagtcaggggccagtgtctcgagcggtcgaggtcgcagacctagaggcgccccacaggccggcccggggcgctgggagcgccggccgcgggccgggtggggatgcctctgcacgtgaagtggccgttccccgcggtgccgccgctcacctggaccctggccagcagcgtcgtcatgggcttggtgggcacctacagctgcttctggaccaagtacatgaaccacctgaccgtgcacaacagggaggtgctgtacgagctcatcgagaagcgaggcccggccacgcccctcatcaccgtgtccaatcaccagtcctgcatggacgaccctcatctctgggggatcctgaaactccgccacatctggaacctgaagttgatgcgttggacccctgcagctgcagacatctgcttcaccaaggagctacactcccacttcttcagcttgggcaagtgtgtgcctgtgtgccgaggagcagaatttttccaagcagagaatgaggggaaaggtgttctagacacaggcaggcacatgccaggtgctggaaaaagaagagagaaaggagatggcgtctaccagaaggggatggacttcattttggagaagctcaaccatggggactgggtgcatatcttcccagaagggaaagtgaacatgagttccgaattcctgcgtttcaagtggggaatcgggcgcctgattgctgagtgtcatctcaaccccatcatcctgcccctgtggcatgtcggaatgaatgacgtccttcctaacagtccgccctacttcccccgctttggacagaaaatcactgtgctgatcgggaagcccttcagtgccctgcctgtactcgagcggctccgggcggagaacaagtcggctgtggagatgcggaaagccctgacggacttcattcaagaggaattccagcatctgaagactcaggcagagcagctccacaaccacctccagcctgggagataggccttgcttgctgccttctggattcttggcccgcacagagctggggctgagggatggactgatgcttttagctcaaacgtggcttttagacagatttgttcatagaccctctcaagtgccctctccgagctggtaggcattccagctcctccgtgcttcctcagttacacaaaggacctcagctgcttctcccacttggccaagcagggaggaagaagcttaggcagggctctctttccttcttgccttcagatgttctctcccaggggctggcttcaggagggagcatagaaggcaggtgagcaaccagttggctaggggagcagggggcccaccagagctgtggagaggggaccctaagactcctcggcctggctcctacccaccgcccttgccgaaccaggagctgctcactacctcctcagggatggccgttggccacgtcttccttctgcctgagcttccccccgaccacaggccctttcctcaggcaaggtctggcctcaggtgggccgcaggcgggaaaagcagcccttggccagaagtcaagcccagccacgtggagcctagagtgagggcctgaggtctggctgcttgcccccatgctggcgccaacaacttctccatcctttctgcctctcaacatcacttgaatcctagggcctgggttttcatgtttttgaaacagaaccataaagcatatgtgttggcttgttgtaaaaaaaaaaaaaaaaaa

SEQ ID NO: 20 - protein, 292 aa, Homo sapiens
MPLHVKWPFPAVPPLTWTLASSVVMGLVGTYSCFWTKYMNHLTVHNREVLYELIEKRGPATPLITVSNHQSCMDDPHLWGILKLRHIWNLKLMRWTPAAADICFTKELHSHFFSLGKCVPVCRGAEFFQAENEGKGVLDTGRHMPGAGKRREKGDGVYQKGMDFILEKLNHGDWVHIFPEGKVNMSSEFLRFKWGIGRLIAECHLNPIILPLWHVGMNDVLPNSPPYFPRFGQKITVLIGKPFSALPVLERLRAENKSAVEMRKALTDFIQEEFQHLKTQAEQLHNHLQPGR

SEQ ID NO: 21 - DNA, 5411 bp, Homo sapiens
gtgtcccatagtgtttccaaacttggaaagggcgggggagggcgggaggatgcggagggcggaggtatgcagacaacgagtcagagtttccccttgaaagcctcaaaagtgtccacgtcctcaaaaagaatggaaccaatttaagaagccagccccgtggccacgtcccttcccccattcgctccctcctctgcgcccccgcaggctcctcccagctgtggctgcccgggcccccagccccagccctcccattggtggaggcccttttggaggcaccctagggccagggaaacttttgccgtataaatagggcagatccgggctttattattttagcaccacggcagcaggaggtttcggctaagttggaggtactggccacgactgcatgcccgcgcccgccaggtgatacctccgccggtgacccaggggctctgcgacacaaggagtctgcatgtctaagtgctagacatgctcagctttgtggatacgcggactttgttgctgcttgcagtaaccttatgcctagcaacatgccaatctttacaagaggaaactgtaagaaagggcccagccggagatagaggaccacgtggagaaaggggtccaccaggccccccaggcagagatggtgaagatggtcccacaggccctcctggtccacctggtcctcctggcccccctggtctcggtgggaactttgctgctcagtatgatggaaaaggagttggacttggccctggaccaatgggcttaatgggacctagaggcccacctggtgcagctggagccccaggccctcaaggtttccaaggacctgctggtgagcctggtgaacctggtcaaactggtcctgcaggtgctcgtggtccagctggccctcctggcaaggctggtgaagatggtcaccctggaaaacccggacgacctggtgagagaggagttgttggaccacagggtgctcgtggtttccctggaactcctggacttcctggcttcaaaggcattaggggacacaatggtctggatggattgaagggacagcccggtgctcctggtgtgaagggtgaacctggtgcccctggtgaaaatggaactccaggtcaaacaggagcccgtgggcttcctggtgagagaggacgtgttggtgcccctggcccagctggtgcccgtggcagtgatggaagtgtgggtcccgtgggtcctgctggtcccattgggtctgctggccctccaggcttcccaggtgcccctggccccaagggtgaaattggagctgttggtaacgctggtcctgctggtcccgccggtccccgtggtgaagtgggtcttccaggcctctccggccccgttggacctcctggtaatcctggagcaaacggccttactggtgccaagggtgctgctggccttcccggcgttgctggggctcccggcctccctggaccccgcggtattcctggccctgttggtgctgccggtgctactggtgccagaggacttgttggtgagcctggtccagctggctccaaaggagagagcggtaacaagggtgagcccggctctgctgggccccaaggtcctcctggtcccagtggtgaagaaggaaagagaggccctaatggggaagctggatctgccggccctccaggacctcctgggctgagaggtagtcctggttctcgtggtcttcctggagctgatggcagagctggcgtcatgggccctcctggtagtcgtggtgcaagtggccctgctggagtccgaggacctaatggagatgctggtcgccctggggagcctggtctcatgggacccagaggtcttcctggttcccctggaaatatcggccccgctggaaaagaaggtcctgtcggcctccctggcatcgacggcaggcctggcccaattggcccagctggagcaagaggagagcctggcaacattggattccctggacccaaaggccccactggtgatcctggcaaaaacggtgataaaggtcatgctggtcttgctggtgctcggggtgctccaggtcctgatggaaacaatggtgctcagggacctcctggaccacagggtgttcaaggtggaaaaggtgaacagggtccccctggtcctccaggcttccagggtctgcctggcccctcaggtcccgctggtgaagttggcaaaccaggagaaaggggtctccatggtgagtttggtctccctggtcctgctggtccaagaggggaacgcggtcccccaggtgagagtggtgctgccggtcctactggtcctattggaagccgaggtccttctggacccccagggcctgatggaaacaagggtgaacctggtgtggttggtgctgtgggcactgctggtccatctggtcctagtggactcccaggagagaggggtgctgctggcatacctggaggcaagggagaaaagggtgaacctggtctcagaggtgaaattggtaaccctggcagagatggtgctcgtggtgctcctggtgctgtaggtgcccctggtcctgctggagccacaggtgaccggggcgaagctggggctgctggtcctgctggtcctgctggtcctcggggaagccctggtgaacgtggtgaggtcggtcctgctggccccaatggatttgctggtcctgctggtgctgctggtcaacctggtgctaaaggagaaagaggagccaaagggcctaagggtgaaaacggtgttgttggtcccacaggccccgttggagctgctggcccagctggtccaaatggtccccccggtcctgctggaagtcgtggtgatggaggcccccctggtatgactggtttccctggtgctgctggacggactggtcccccaggaccctctggtatttctggccctcctggtccccctggtcctgctgggaaagaagggcttcgtggtcctcgtggtgaccaaggtccagttggccgaactggagaagtaggtgcagttggtccccctggcttcgctggtgagaagggtccctctggagaggctggtactgctggacctcctggcactccaggtcctcagggtcttcttggtgctcctggtattctgggtctccctggctcgagaggtgaacgtggtctaccaggtgttgctggtgctgtgggtgaacctggtcctcttggcattgccggccctcctggggcccgtggtcctcctggtgctgtgggtagtcctggagtcaacggtgctcctggtgaagctggtcgtgatggcaaccctgggaacgatggtcccccaggtcgcgatggtcaacccggacacaagggagagcgcggttaccctggcaatattggtcccgttggtgctgcaggtgcacctggtcctcatggccccgtgggtcctgctggcaaacatggaaaccgtggtgaaactggtccttctggtcctgttggtcctgctggtgctgttggcccaagaggtcctagtggcccacaaggcattcgtggcgataagggagagcccggtgaaaaggggcccagaggtcttcctggcttaaagggacacaatggattgcaaggtctgcctggtatcgctggtcaccatggtgatcaaggtgctcctggctccgtgggtcctgctggtcctaggggccctgctggtccttctggccctgctggaaaagatggtcgcactggacatcctggtacagttggacctgctggcattcgaggccctcagggtcaccaaggccctgctggcccccctggtccccctggccctcctggacctccaggtgtaagcggtggtggttatgactttggttacgatggagacttctacagggctgaccagcctcgctcagcaccttctctcagacccaaggactatgaagttgatgctactctgaagtctctcaacaaccagattgagacccttcttactcctgaaggctctagaaagaacccagctcgcacatgccgtgacttgagactcagccacccagagtggagcagtggttactactggattgaccctaaccaaggatgcactatggatgctatcaaagtatactgtgatttctctactggcgaaacctgtatccgggcccaacctgaaaacatcccagccaagaactggtataggagctccaaggacaagaaacacgtctggctaggagaaactatcaatgctggcagccagtttgaatataatgtagaaggagtgacttccaaggaaatggctacccaacttgccttcatgcgcctgctggccaactatgcctctcagaacatcacctaccactgcaagaacagcattgcatacatggatgaggagactggcaacctgaaaaaggctgtcattctacagggctctaatgatgttgaacttgttgctgagggcaacagcaggttcacttacactgttcttgtagatggctgctctaaaaagacaaatgaatggggaaagacaatcattgaatacaaaacaaataagccatcacgcctgcccttccttgatattgcacctttggacatcggtggtgctgaccaggaattctttgtggacattggcccagtctgtttcaaataaatgaactcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttcccccgctcccccaaaaatttgaatttttttttcaacactcttacacctgttatggaaaatgtcaacctttgtaagaaaaccaaaataaaaattgaaaaataaaaaccataaacatttgcaccacttgtggcttttgaatatcttccacagagggaagtttaaaacccaaacttccaaaggtttaaactacctcaaaacactttcccatgagtgtgatccacattgttaggtgctgacctagacagagatgaactgaggtccttgttttgttttgttcataatacaaaggtgctaattaatagtatttcagatacttgaagaatgttgatggtgctagaagaatttgagaagaaatactcctgtattgagttgtatcgtgtggtgtattttttaaaaaatttgatttagcattcatattttccatcttattcccaattaaaagtatgcagattatttgcccaaatcttcttcagattcagcatttgttctttgccagtctcattttcatcttcttccatggttccacagaagctttgtttcttgggcaagcagaaaaattaaattgtacctattttgtatatgtgagatgtttaaataaattgtgaaaaaaatgaaataaagcatgtttggttttccaaaagaacatat

SEQ ID NO: 22 - protein, 1366 aa, Homo sapiens
MLSFVDTRTLLLLAVTLCLATCQSLQEETVRKGPAGDRGPRGERGPPGPPGRDGEDGPTGPPGPPGPPGPPGLGGNFAAQYDGKGVGLGPGPMGLMGPRGPPGAAGAPGPQGFQGPAGEPGEPGQTGPAGARGPAGPPGKAGEDGHPGKPGRPGERGVVGPQGARGFPGTPGLPGFKGIRGHNGLDGLKGQPGAPGVKGEPGAPGENGTPGQTGARGLPGERGRVGAPGPAGARGSDGSVGPVGPAGPIGSAGPPGFPGAPGPKGEIGAVGNAGPAGPAGPRGEVGLPGLSGPVGPPGNPGANGLTGAKGAAGLPGVAGAPGLPGPRGIPGPVGAAGATGARGLVGEPGPAGSKGESGNKGEPGSAGPQGPPGPSGEEGKRGPNGEAGSAGPPGPPGLRGSPGSRGLPGADGRAGVMGPPGSRGASGPAGVRGPNGDAGRPGEPGLMGPRGLPGSPGNIGPAGKEGPVGLPGIDGRPGPIGPAGARGEPGNIGFPGPKGPTGDPGKNGDKGHAGLAGARGAPGPDGNNGAQGPPGPQGVQGGKGEQGPPGPPGFQGLPGPSGPAGEVGKPGERGLHGEFGLPGPAGPRGERGPPGESGAAGPTGPIGSRGPSGPPGPDGNKGEPGVVGAVGTAGPSGPSGLPGERGAAGIPGGKGEKGEPGLRGEIGNPGRDGARGAPGAVGAPGPAGATGDRGEAGAAGPAGPAGPRGSPGERGEVGPAGPNGFAGPAGAAGQPGAKGERGAKGPKGENGVVGPTGPVGAAGPAGPNGPPGPAGSRGDGGPPGMTGFPGAAGRTGPPGPSGISGPPGPPGPAGKEGLRGPRGDQGPVGRTGEVGAVGPPGFAGEKGPSGEAGTAGPPGTPGPQGLLGAPGILGLPGSRGERGLPGVAGAVGEPGPLGIAGPPGARGPPGAVGSPGVNGAPGEAGRDGNPGNDGPPGRDGQPGHKGERGYPGNIGPVGAAGAPGPHGPVGPAGKHGNRGETGPSGPVGPAGAVGPRGPSGPQGIRGDKGEPGEKGPRGLPGLKGHNGLQGLPGIAGHHGDQGAPGSVGPAGPRGPAGPSGPAGKDGRTGHPGTVGPAGIRGPQGHQGPAGPPGPPGPPGPPGVSGGGYDFGYDGDFYRADQPRSAPSLRPKDYEVDATLKSLNNQIETLLTPEGSRKNPARTCRDLRLSHPEWSSGYYWIDPNQGCTMDAIKVYCDFSTGETCIRAQPENIPAKNWYRSSKDKKHVWLGETINAGSQFEYNVEGVTSKEMATQLAFMRLLANYASQNITYHCKNSIAYMDEETGNLKKAVILQGSNDVELVAEGNSRFTYTVLVDGCSKKTNEWGKTIIEYKTNKPSRLPFLDIAPLDIGGADQEFFVDIGPVCFK

SEQ ID NO: 23 - DNA, 7888 bp, Homo sapiens
gtgcaggctgctcccggggtaggtgagggaagcgcggaggcggcgcgcgggggcagtggtcggcgagcagcgcggtcctcgctaggggcgcccacccgtcagtctctccggcgcgagccgccgccaccgcccgcgccggagtcaggcccctgggcccccaggctcaagcagcgaagcggcctccgggggacgccgctaggcgagaggaacgcgccggtgcccttgccttcgccgtgacccagcgtgcgggcggcgggatgagagggagccatcgggccgcgccggccctgcggccccgggggcggctctggcccgtgctggccgtgctggcggcggccgccgcggcgggctgtgcccaggcagccatggacgagtgcacggacgagggcgggcggccgcagcgctgcatgcccgagttcgtcaacgccgccttcaacgtgactgtggtggccaccaacacgtgtgggactccgcccgaggaatactgtgtgcagaccggggtgaccggggtcaccaagtcctgtcacctgtgcgacgccgggcagccccacctgcagcacggggcagccttcctgaccgactacaacaaccaggccgacaccacctggtggcaaagccagaccatgctggccggggtgcagtaccccagctccatcaacctcacgctgcacctgggaaaagcttttgacatcacctatgtgcgtctcaagttccacaccagccgcccggagagctttgccatttacaagcgcacacgggaagacgggccctggattccttaccagtactacagtggttcctgtgagaacacctactccaaggcaaaccgcggcttcatcaggacaggaggggacgagcagcaggccttgtgtactgatgaattcagtgacatttctcccctcactgggggcaacgtggccttttctaccctggaaggaaggcccagcgcctataactttgacaatagccctgtgctgcaggaatgggtaactgccactgacatcagagtaactcttaatcgcctgaacacttttggagatgaagtgtttaacgatcccaaagttctcaagtcctattattatgccatctctgattttgctgtaggtggcagatgtaaatgtaatggacacgcaagcgagtgtatgaagaacgaatttgataagctggtgtgtaattgcaaacataacacatatggagtagactgtgaaaagtgtcttcctttcttcaatgaccggccgtggaggagggcaactgcggaaagtgccagtgaatgcctgccctgtgattgcaatggtcgatcccaggaatgctacttcgaccctgaactctatcgttccactggccatgggggccactgtaccaactgccaggataacacagatggcgcccactgtgagaggtgccgagagaacttcttccgccttggcaacaatgaagcctgctcttcatgccactgtagtcctgtgggctctctaagcacacagtgtgatagttacggcagatgcagctgtaagccaggagtgatgggggacaaatgtgaccgttgccagcctggattccattctctcactgaagcaggatgcaggccatgctcttgtgatccctctggcagcatagatgaatgtaatattgaaacaggaagatgtgtttgcaaagacaatgtcgaaggcttcaattgtgaaagatgcaaacctggattttttaatctggaatcatctaatcctcggggttgcacaccctgcttctgctttgggcattcttctgtctgtacaaacgctgttggctacagtgtttattctatctcctctacctttcagattgatgaggatgggtggcgtgcggaacagagagatggctctgaagcatctctcgagtggtcctctgagaggcaagatatcgccgtgatctcagacagctactttcctcggtacttcattgctcctgcaaagttcttgggcaagcaggtgttgagttatggtcagaacctctccttctcctttcgagtggacaggcgagatactcgcctctctgcagaagaccttgtgcttgagggagctggcttaagagtatctgtacccttgatcgctcagggcaattcctatccaagtgagaccactgtgaagtatgtcttcaggctccatgaagcaacagattacccttggaggcctgctcttaccccttttgaatttcagaagctcctaaacaacttgacctctatcaagatacgtgggacatacagtgagagaagtgctggatatttggatgatgtcaccctggcaagtgctcgtcctgggcctggagtccctgcaacttgggtggagtcctgcacctgtcctgtgggatatggagggcagttttgtgagatgtgcctctcaggttacagaagagaaactcctaatcttggaccatacagtccatgtgtgctttgcgcctgcaatggacacagcgagacctgtgatcctgagacaggtgtttgtaactgcagagacaatacggctggcccgcactgtgagaagtgcagtgatgggtactatggagattcaactgcaggcacctcctccgattgccaaccctgtccgtgtcctggaggttcaagttgtgctgttgttcccaagacaaaggaggtggtgtgcaccaactgtcctactggcaccactggtaagagatgtgagctctgtgatgatggctactttggagaccccctgggtagaaacggccctgtgagactttgccgcctgtgccagtgcagtgacaacatcgatcccaatgcagttggaaattgcaatcgcttgacgggagaatgcctgaagtgcatctataacactgctggcttctattgtgaccggtgcaaagacggattttttggaaatcccctggctcccaatccagcagacaaatgcaaagcctgcaattgcaatctgtatgggaccatgaagcagcagagcagctgtaaccccgtgacggggcagtgtgaatgtttgcctcacgtgactggccaggactgtggtgcttgtgaccctggattctacaatctgcagagtgggcaaggctgtgagaggtgtgactgccatgccttgggctccaccaatgggcagtgtgacatccgcaccggccagtgtgagtgccagcccggcatcactggtcagcactgtgagcgctgtgaggtcaaccactttgggtttggacctgaaggctgcaaaccctgtgactgtcatcctgagggatctctttcacttcagtgcaaagatgatggtcgctgtgaatgcagagaaggctttgtgggaaatcgctgtgaccagtgtgaagaaaactatttctacaatcggtcttggcctggctgccaggaatgtccagcttgttaccggctggtaaaggataaggttgctgatcatagagtgaagctccaggaattagagagtctcatagcaaaccttggaactggggatgagatggtgacagatcaagccttcgaggatagactaaaggaagcagagagggaagttatggacctccttcgtgaggcccaggatgtcaaagatgttgaccagaatttgatggatcgcctacagagagtgaataacactctgtccagccaaattagccgtttacagaatatccggaataccattgaagagactggaaacttggctgaacaagcgcgtgcccatgtagagaacacagagcggttgattgaaatcgcatccagagaacttgagaaagcaaaagtcgctgctgccaatgtgtcagtcactcagccagaatctacaggggacccaaacaacatgactcttttggcagaagaggctcgaaagcttgctgaacgtcataaacaggaagctgatgacattgttcgagtggcaaagacagccaatgatacgtcaactgaggcatacaacctgcttctgaggacactggcaggagaaaatcaaacagcatttgagattgaagagcttaataggaagtatgaacaagcgaagaacatctcacaggatctggaaaaacaagctgcccgagtacatgaggaggccaaaagggccggtgacaaagctgtggagatctatgccagcgtggctcagctgagccctttggactctgagacactggagaatgaagcaaataacataaagatggaagctgagaatctggaacaactgattgaccagaaattaaaagattatgaggacctcagagaagatatgagagggaaggaacttgaagtcaagaaccttctggagaaaggcaagactgaacagcagaccgcagaccaactcctagcccgagctgatgctgccaaggccctcgctgaagaagctgcaaagaagggacgggataccttacaagaagctaatgacattctcaacaacctgaaagattttgataggcgtgtgaacgataacaagacggccgcagaggaggcactaaggaagattcctgccatcaaccagaccatcactgaagccaatgaaaagaccagagaagcccagcaggccctgggcagtgctgcggcggatgccacagaggccaagaacaaggcccatgaggcggagaggatcgcgagcgctgtccaaaagaatgccaccagcaccaaggcagaagctgaaagaacttttgcagaagttacagatctggataatgaggtgaacaatatgttgaagcaactgcaggaagcagaaaaagagctaaagagaaaacaagatgacgctgaccaggacatgatgatggcagggatggcttcacaggctgctcaagaagccgagatcaatgccagaaaagccaaaaactctgttactagcctcctcagcattattaatgacctcttggagcagctggggcagctggatacagtggacctgaataagctaaacgagattgaaggcaccctaaacaaagccaaagatgaaatgaaggtcagcgatcttgataggaaagtgtctgacctggagaatgaagccaagaagcaggaggctgccatcatggactataaccgagatatcgaggagatcatgaaggacattcgcaatctggaggacatcaggaagaccttaccatctggctgcttcaacaccccgtccattgaaaagccctagtgtctttagggctggaaggcagcatccctctgacaggggggcagttgtgaggccacagagtgccttgacacaaagattacatttttcagacccccactcctctgctgctgtccatgactgtccttttgaaccaggaaaagtcacagagtttaaagagaagcaaattaaacatcctgaatcgggaacaaagggttttatctaataaagtgtctcttccattcacgttgctaccttacccacactttcccttctgatttgcgtgaggacgtggcatcctacgttactgtacagtggcataagcacatcgtgtgagcccatgtatgctggggtagagcaagtagccctcccctgtctcatcgataccagcagaacctcctcagtctcagtactcttgtttctatgaaggaaaagtttggctactaacagtagcattgtgatggccagtatatccagtccatggataaagaaaatgcatctgcatctcctacccctcttccttctaagcaaaaggaaataaacatcctgtgccaaaggtattggtcatttagaatgtcggtagccatccatcagtgcttttagttattatgagtgtaggacactgagccatccgtgggtcaggatgcaattatttataaaagtctccaggtgaacatggctgaagatttttctagtatattaataattgactaggaagatgaactttttttcagatctttgggcagctgataatttaaatctggatgggcagcttgcactcaccaatagaccaaaagacatcttttgatattcttataaatggaacttacacagaagaaatagggatatgataaccactaaaattttgttttcaaaatcaaactaattcttacagcttttttattagttagtcttggaactagtgttaagtatctggcagagaacagttaatccctaaggtcttgacaaaacagaagaaaaacaagcctcctcgtcctagtcttttctagcaaagggataaaacttagatggcagcttgtactgtcagaatcccgtgtatccatttgttcttctgttggagagatgagacatttgacccttagctccagttttcttctgatgtttccatcttccagaatccctcaaaaaacattgtttgccaaatcctggtggcaaatacttgcactcagtatttcacacagctgccaacgctatcgagttcctgcactttgtgatttaaatccactctaaaccttccctctaagtgtagagggaagacccttacgtggagtttcctagtgggcttctcaacttttgatcctcagctctgtggttttaagaccacagtgtgacagttccctgccacacacccccttcctcctaccaacccacctttgagattcatatatagcctttaacactatgcaactttgtactttgcgtagcaggggcggggtggggggaaagaaactattatctgacacactggtgctattaattatttcaaatttatatttttgtgtgaatgttttgtgttttgtttatcatgattatagaataaggaatttatgtaaatatacttagtcctatttctagaatgacactctgttcactttgctcaatttttcctcttcactggcacaatgtatctgaatacctccttccctcccttctagaattctttggattgtactccaaagaattgtgccttgtgtttgcagcatctccattctctaaaattaatataattgctttcctccacacccagccactgtaaagaggtaacttgggtcctcttccattgcagtcctgatgatcctaacctgcagcacggtggttttacaatgttccagagcaggaacgccaggttgacaagctatggtaggattaggaaagtttgctgaagaggatctttgacgccacagtgggactagccaggaatgagggagaaatgccctttctggcaattgttggagctggataggtaagttttataagggagtacattttgactgagcacttagggcatcaggaacagtgctacttactgatgggtagactgggagaggtggtgtaacttagttcttgatgatcccacttcctgtttccatctgcttgggatataccagagtttaccacaagtgttttgacgatatactcctgagctttcactctgctgcttctcccaggcctcttctactatggcaggagatgtggcgtgctgttgcaaagttttcacgtcattgtttcctggctagttcatttcattaagtggctacatcctaacatatgcatttggtcaaggttgcagaagaggactgaagattgactgccaagctagtttgggtgaagttcactccagcaagtctcaggccacaatggggtggtttggtttggtttccttttaactttctttttgttatttgcttttctcctccacctgtgtggtatattttttaagcagaattttattttttaaaataaaaggttctttacaagatgataccttaattacactcccgcaacacagccattattttattgtctagctccagttatctgtattttatgtaatgtaattgacaggatggctgctgcagaatgctggttgacacagggattattatactgctatttttccctgaatttttttcctttgaattccaactgtggaccttttatatgtgccttcactttagctgtttgccttaatctctacagccttgctctccggggtggttaataaaatgcaacacttggcatttttatgttttaagaaaaacagtattttatttataataaaatctgaatatttgtaacccttt

SEQ ID NO: 24 - protein, 1609 aa, Homo sapiens
MRGSHRAAPALRPRGRLWPVLAVLAAAAAAGCAQAAMDECTDEGGRPQRCMPEFVNAAFNVTVVATNTCGTPPEEYCVQTGVTGVTKSCHLCDAGQPHLQHGAAFLTDYNNQADTTWWQSQTMLAGVQYPSSINLTLHLGKAFDITYVRLKFHTSRPESFAIYKRTREDGPWIPYQYYSGSCENTYSKANRGFIRTGGDEQQALCTDEFSDISPLTGGNVAFSTLEGRPSAYNFDNSPVLQEWVTATDIRVTLNRLNTFGDEVFNDPKVLKSYYYAISDFAVGGRCKCNGHASECMKNEFDKLVCNCKHNTYGVDCEKCLPFFNDRPWRRATAESASECLPCDCNGRSQECYFDPELYRSTGHGGHCTNCQDNTDGAHCERCRENFFRLGNNEACSSCHCSPVGSLSTQCDSYGRCSCKPGVMGDKCDRCQPGFHSLTEAGCRPCSCDPSGSIDECNIETGRCVCKDNVEGFNCERCKPGFFNLESSNPRGCTPCFCFGHSSVCTNAVGYSVYSISSTFQIDEDGWRAEQRDGSEASLEWSSERQDIAVISDSYFPRYFIAPAKFLGKQVLSYGQNLSFSFRVDRRDTRLSAEDLVLEGAGLRVSVPLIAQGNSYPSETTVKYVFRLHEATDYPWRPALTPFEFQKLLNNLTSIKIRGTYSERSAGYLDDVTLASARPGPGVPATWVESCTCPVGYGGQFCEMCLSGYRRETPNLGPYSPCVLCACNGHSETCDPETGVCNCRDNTAGPHCEKCSDGYYGDSTAGTSSDCQPCPCPGGSSCAVVPKTKEVVCTNCPTGTTGKRCELCDDGYFGDPLGRNGPVRLCRLCQCSDNIDPNAVGNCNRLTGECLKCIYNTAGFYCDRCKDGFFGNPLAPNPADKCKACNCNLYGTMKQQSSCNPVTGQCECLPHVTGQDCGACDPGFYNLQSGQGCERCDCHALGSTNGQCDIRTGQCECQPGITGQHCERCEVNHFGFGPEGCKPCDCHPEGSLSLQCKDDGRCECREGFVGNRCDQCEENYFYNRSWPGCQECPACYRLVKDKVADHRVKLQELESLIANLGTGDEMVTDQAFEDRLKEAEREVMDLLREAQDVKDVDQNLMDRLQRVNNTLSSQISRLQNIRNTIEETGNLAEQARAHVENTERLIEIASRELEKAKVAAANVSVTQPESTGDPNNMTLLAEEARKLAERHKQEADDIVRVAKTANDTSTEAYNLLLRTLAGENQTAFEIEELNRKYEQAKNISQDLEKQAARVHEEAKRAGDKAVEIYASVAQLSPLDSETLENEANNIKMEAENLEQLIDQKLKDYEDLREDMRGKELEVKNLLEKGKTEQQTADQLLARADAAKALAEEAAKKGRDTLQEANDILNNLKDFDRRVNDNKTAAEEALRKIPAINQTITEANEKTREAQQALGSAAADATEAKNKAHEAERIASAVQKNATSTKAEAERTFAEVTDLDNEVNNMLKQLQEAEKELKRKQDDADQDMMMAGMASQAAQEAEINARKAKNSVTSLLSIINDLLEQLGQLDTVDLNKLNEIEGTLNKAKDEMKVSDLDRKVSDLENEAKKQEAAIMDYNRDIEEIMKDIRNLEDIRKTLPSGCFNTPSIEKP

SEQ ID NO: 25 - DNA, 3604 bp, Homo sapiens
gggagaaggaggaggccgggggaaggaggagacaggaggaggagggaccacggggtggaggggagatagacccagcccagagctctgagtggtttcctgttgcctgtctctaaacccctccacattcccgcggtccttcagactgcccggagagcgcgctctgcctgccgcctgcctgcctgccactgagggttcccagcaccatgagggcctggatcttctttctcctttgcctggccgggagggccttggcagcccctcagcaagaagccctgcctgatgagacagaggtggtggaagaaactgtggcagaggtgactgaggtatctgtgggagctaatcctgtccaggtggaagtaggagaatttgatgatggtgcagaggaaaccgaagaggaggtggtggcggaaaatccctgccagaaccaccactgcaaacacggcaaggtgtgcgagctggatgagaacaacacccccatgtgcgtgtgccaggaccccaccagctgcccagcccccattggcgagtttgagaaggtgtgcagcaatgacaacaagaccttcgactcttcctgccacttctttgccacaaagtgcaccctggagggcaccaagaagggccacaagctccacctggactacatcgggccttgcaaatacatccccccttgcctggactctgagctgaccgaattccccctgcgcatgcgggactggctcaagaacgtcctggtcaccctgtatgagagggatgaggacaacaaccttctgactgagaagcagaagctgcgggtgaagaagatccatgagaatgagaagcgcctggaggcaggagaccaccccgtggagctgctggcccgggacttcgagaagaactataacatgtacatcttccctgtacactggcagttcggccagctggaccagcaccccattgacgggtacctctcccacaccgagctggctccactgcgtgctcccctcatccccatggagcattgcaccacccgctttttcgagacctgtgacctggacaatgacaagtacatcgccctggatgagtgggccggctgcttcggcatcaagcagaaggatatcgacaaggatcttgtgatctaaatccactccttccacagtaccggattctctctttaaccctccccttcgtgtttcccccaatgtttaaaatgtttggatggtttgttgttctgcctggagacaaggtgctaacatagatttaagtgaatacattaacggtgctaaaaatgaaaattctaacccaagacatgacattcttagctgtaacttaactattaaggccttttccacacgcattaatagtcccatttttctcttgccatttgtagctttgcccattgtcttattggcacatgggtggacacggatctgctgggctctgccttaaacacacattgcagcttcaacttttctctttagtgttctgtttgaaactaatacttaccgagtcagactttgtgttcatttcatttcagggtcttggctgcctgtgggcttccccaggtggcctggaggtgggcaaagggaagtaacagacacacgatgttgtcaaggatggttttgggactagaggctcagtggtgggagagatccctgcagaacccaccaaccagaacgtggtttgcctgaggctgtaactgagagaaagattctggggctgtgttatgaaaatatagacattctcacataagcccagttcatcaccatttcctcctttacctttcagtgcagtttcttttcacattaggctgttggttcaaacttttgggagcacggactgtcagttctctgggaagtggtcagcgcatcctgcagggcttctcctcctctgtcttttggagaaccagggctcttctcaggggctctagggactgccaggctgtttcagccaggaaggccaaaatcaagagtgagatgtagaaagttgtaaaatagaaaaagtggagttggtgaatcggttgttctttcctcacatttggatgattgtcataaggtttttagcatgttcctccttttcttcaccctccccttttttcttctattaatcaagagaaacttcaaagttaatgggatggtcggatctcacaggctgagaactcgttcacctccaagcatttcatgaaaaagctgcttcttattaatcatacaaactctcaccatgatgtgaagagtttcacaaatccttcaaaataaaaagtaatgacttagaaactgccttcctgggtgatttgcatgtgtcttagtcttagtcaccttattatcctgacacaaaaacacatgagcatacatgtctacacatgactacacaaatgcaaacctttgcaaacacattatgcttttgcacacacacacctgtacacacacaccggcatgtttatacacagggagtgtatggttcctgtaagcactaagttagctgttttcatttaatgacctgtggtttaacccttttgatcactaccaccattatcagcaccagactgagcagctatatccttttattaatcatggtcattcattcattcattcattcacaaaatatttatgatgtatttactctgcaccaggtcccatgccaagcactggggacacagttatggcaaagtagacaaagcatttgttcatttggagcttagagtccaggaggaatacattagataatgacacaatcaaatataaattgcaagatgtcacaggtgtgatgaagggagagtaggagagaccatgagtatgtgtaacaggaggacacagcattattctagtgctgtactgttccgtacggcagccactacccacatgtaactttttaagatttaaatttaaattagttaacattcaaaacgcagctccccaatcacactagcaacatttcaagtgcttgagagccatgcatgattagtggttaccctattgaataggtcagaagtagaatcttttcatcatcacagaaagttctattggacagtgctcttctagatcatcataagactacagagcacttttcaaagctcatgcatgttcatcatgttagtgtcgtattttgagctggggttttgagactccccttagagatagagaaacagacccaagaaatgtgctcaattgcaatgggccacatacctagatctccagatgtcatttcccctctcttattttaagttatgttaagattactaaaacaataaaagctcctaaaaaatcaaactgtattctggtgttctcttctacacagtgggagggcgagcagtaggagagattggcccatttggtgctggccatttgaggaatgcaagcccagcactagtctcataatctctaggaatctgtagagagaggaattgaagtaaatttcagcattggctcattcagtcattcggcgacattcatcaggtacctgcaatgtgttaggggatcttatgagtaggcagcgtgcgtgatccttgctcccctggagctttctaacattctagcaggcagaccacacataaatttgcaatactgtttctgataaaaacgtgctgtaaaggaaataaagcagagaactatcatggaaaaaaaaaaaaaaaaaa

SEQ ID NO: 26 - protein, 303 aa, Homo sapiens
MRAWIFFLLCLAGRALAAPQQEALPDETEVVEETVAEVTEVSVGANPVQVEVGEFDDGAEETEEEVVAENPCQNHHCKHGKVCELDENNTPMCVCQDPTSCPAPIGEFEKVCSNDNKTFDSSCHFFATKCTLEGTKKGHKLHLDYIGPCKYIPPCLDSELTEFPLRMRDWLKNVLVTLYERDEDNNLLTEKQKLRVKKIHENEKRLEAGDHPVELLARDFEKNYNMYIFPVHWQFGQLDQHPIDGYLSHTELAPLRAPLIPMEHCTTRFFETCDLDNDKYIALDEWAGCFGIKQKDIDKDLVI

SEQ ID NO: 27 - DNA, 2715 bp, Homo sapiens
atgcgccgcccggcttggaaggtggggcttcgcccgggggcgggccttcgccgggggtaggactccggccttggtggcgggtggctggcggttccgttaggtctgagggagcgatggcggtacgcgcgttgaagctgctgaccacactgctggctgtcgtggccgctgcctcccaagccgaggtcgagtccgaggcaggatggggcatggtgacgcctgatctgctcttcgccgaggggaccgcagcctacgcgcgcggggactggcccggggtggtcctgagcatggaacgggcgctgcgctcccgggcagccctccgcgcccttcgcctgcgctgccgcacccagtgtgccgccgacttcccgtgggagctggaccccgactggtcccccagcccggcccaggcctcgggcgccgccgccctgcgcgacctgagcttcttcgggggccttctgcgtcgcgctgcctgcctgcgccgctgcctcgggccgccggccgcccactcgctcagcgaagagatggagctggagttccgcaagcggagcccctacaactacctgcaggtcgcctacttcaagatcaacaagttggagaaagctgttgctgcagcacacaccttcttcgtgggcaatcctgagcacatggaaatgcagcagaacctagactattaccaaaccatgtctggagtgaaggaggccgacttcaaggatcttgagactcaaccccatatgcaagaatttcgactgggagtgcgactctactcagaggaacagccacaggaagctgtgccccacctagaggcggcgctgcaagaatactttgtggcctatgaggagtgccgtgccctctgcgaagggccctatgactacgatggctacaactaccttgagtacaacgctgacctcttccaggccatcacagatcattacatccaggtcctcaactgtaagcagaactgtgtcacggagcttgcttcccacccaagtcgagagaagccctttgaagacttcctcccatcgcattataattatctgcagtttgcctactataacattgggaattatacacaggctgttgaatgtgccaagacctatcttctcttcttccccaatgacgaggtgatgaaccaaaatttggcctattatgcagctatgcttggagaagaacacaccagatccatcggcccccgtgagagtgccaaggagtaccgacagcgaagcctactggaaaaagaactgcttttcttcgcttatgatgtttttggaattccctttgtggatccggattcatggactccagaagaagtgattcccaagagattgcaagagaaacagaagtcagaacgggaaacagccgtacgcatctcccaggagattgggaaccttatgaaggaaatcgagacccttgtggaagagaagaccaaggagtcactggatgtgagcagactgacccgggaaggtggccccctgctgtatgaaggcatcagtctcaccatgaactccaaactcctgaatggttcccagcgggtggtgatggacggcgtaatctctgaccacgagtgtcaggagctgcagagactgaccaatgtggcagcaacctcaggagatggctaccggggtcagacctccccacatactcccaatgaaaagttctatggtgtcactgtcttcaaagccctcaagctggggcaagaaggcaaagttcctctgcagagtgcccacctgtactacaacgtgacggagaaggtgcggcgcatcatggagtcctacttccgcctggatacgcccctctacttttcctactctcatctggtgtgccgcactgccatcgaagaggtccaggcagagaggaaggatgatagtcatccagtccacgtggacaactgcatcctgaatgccgagaccctcgtgtgtgtcaaagagcccccagcctacaccttccgcgactacagcgccatcctttacctaaatggggacttcgatggcggaaacttttatttcactgaactggatgccaagaccgtgacggcagaggtgcagcctcagtgtggaagagccgtgggattctcttcaggcactgaaaacccacatggagtgaaggctgtcaccagggggcagcgctgtgccatcgccctgtggttcaccctggaccctcgacacagcgagcgggtgagagcagctcgagcgggacagggtgcaggcagatgacctggtgaagatgctcttcagcccagaagagatggacctctcccaggagcagcccctggatgcccagcagggcccccccgaacctgcacaagagtctctctcaggcagtgaatcgaagcccaaggatgagctatgacagcgtccaggtcagacggatgggtgactagacccatggagaggaactcttctgcactctgagctggccagcccctcggggctgcagagcagtgagcctacatctgccactcagccgaggggaccctgctcacagccttctacatggtgctactgctcttggagtggacatgaccagacaccgcaccccctggatctggctgagggctcaggacacaggcccagccacccccaggggcctccacaggccgctgcatgacagcgatacagtacttaagtgtctgtgtagacaaccaaagaataaatgattcatggttttttttacttggtttgttcagacaatggaaatttgcccattctgtcaaaaaaaaaa

SEQ ID NO: 28 - protein, 697 aa, Homo sapiens
MAVRALKLLTTLLAVVAAASQAEVESEAGWGMVTPDLLFAEGTAAYARGDWPGVVLSMERALRSRAALRALRLRCRTQCAADFPWELDPDWSPSPAQASGAAALRDLSFFGGLLRRAACLRRCLGPPAAHSLSEEMELEFRKRSPYNYLQVAYFKINKLEKAVAAAHTFFVGNPEHMEMQQNLDYYQTMSGVKEADFKDLETQPHMQEFRLGVRLYSEEQPQEAVPHLEAALQEYFVAYEECRALCEGPYDYDGYNYLEYNADLFQAITDHYIQVLNCKQNCVTELASHPSREKPFEDFLPSHYNYLQFAYYNIGNYTQAVECAKTYLLFFPNDEVMNQNLAYYAAMLGEEHTRSIGPRESAKEYRQRSLLEKELLFFAYDVFGIPFVDPDSWTPEEVIPKRLQEKQKSERETAVRISQEIGNLMKEIETLVEEKTKESLDVSRLTREGGPLLYEGISLTMNSKLLNGSQRVVMDGVISDHECQELQRLTNVAATSGDGYRGQTSPHTPNEKFYGVTVFKALKLGQEGKVPLQSAHLYYNVTEKVRRIMESYFRLDTPLYFSYSHLVCRTAIEEVQAERKDDSHPVHVDNCILNAETLVCVKEPPAYTFRDYSAILYLNGDFDGGNFYFTELDAKTVTAEVQPQCGRAVGFSSGTENPHGVKAVTRGQRCAIALWFTLDPRHSERVRAARAGQGAGR

SEQ ID NO: 29 - DNA, 4246 bp, Homo sapiens
gctctcactctggctgggagcagaaggcagcctcggtctctgggcggcggcggcggcccactctgccctggccgcgctgtgtggtgaccgcaggccccagacatgagggcggcccgtgctctgctgcccctgctgctgcaggcctgctggacagccgcgcaggatgagccggagaccccgagggccgtggccttccaggactgccccgtggacctgttctttgtgctggacacctctgagagcgtggccctgaggctgaagccctacggggccctcgtggacaaagtcaagtccttcaccaagcgcttcatcgacaacctgagggacaggtactaccgctgtgaccgaaacctggtgtggaacgcaggcgcgctgcactacagtgacgaggtggagatcatccaaggcctcacgcgcatgcctggcggccgcgacgcactcaaaagcagcgtggacgcggtcaagtactttgggaagggcacctacaccgactgcgctatcaagaaggggctggagcagctcctcgtggggggctcccacctgaaggagaataagtacctgattgtggtgaccgacgggcaccccctggagggctacaaggaaccctgtggggggctggaggatgctgtgaacgaggccaagcacctgggcgtcaaagtcttctcggtggccatcacacccgaccacctggagccgcgtctgagcatcatcgccacggaccacacgtaccggcgcaacttcacggcggctgactggggccagagccgcgacgcagaggaggccatcagccagaccatcgacaccatcgtggacatgatcaaaaataacgtggagcaagtgtgctgctccttcgaatgccagcctgcaagaggacctccggggctccggggcgaccccggctttgagggagaacgaggcaagccggggctcccaggagagaagggagaagccggagatcctggaagacccggggacctcggacctgttgggtaccagggaatgaagggagaaaaagggagccgtggggagaagggctccaggggacccaagggctacaagggagagaagggcaagcgtggcatcgacggggtggacggcgtgaagggggagatggggtacccaggcctgccaggctgcaagggctcgcccgggtttgacggcattcaaggaccccctggccccaagggagaccccggtgcctttggactgaaaggagaaaagggcgagcctggagctgacggggaggcggggagaccagggagctcgggaccatctggagacgagggccagccgggagagcctgggccccccggagagaaaggagaggcgggcgacgaggggaacccaggacctgacggtgcccccggggagcggggtggccctggagagagaggaccacgggggaccccaggcacgcggggaccaagaggagaccctggtgaagctggcccgcagggtgatcagggaagagaaggccccgttggtgtccctggagacccgggcgaggctggccctatcggacctaaaggctaccgaggcgatgagggtcccccagggtccgagggtgccagaggagccccaggacctgccggaccccctggagacccggggctgatgggtgaaaggggagaagacggccccgctggaaatggcaccgagggcttccccggcttccccgggtatccgggcaacaggggcgctcccgggataaacggcacgaagggctaccccggcctcaagggggacgagggagaagccggggaccccggagacgataacaacgacattgcaccccgaggagtcaaaggagcaaaggggtaccggggtcccgagggcccccagggacccccaggacaccaaggaccgcctgggccggacgaatgcgagattttggacatcatcatgaaaatgtgctcttgctgtgaatgcaagtgcggccccatcgacctcctgttcgtgctggacagctcagagagcattggcctgcagaacttcgagattgccaaggacttcgtcgtcaaggtcatcgaccggctgagccgggacgagctggtcaagttcgagccagggcagtcgtacgcgggtgtggtgcagtacagccacagccagatgcaggagcacgtgagcctgcgcagccccagcatccggaacgtgcaggagctcaaggaagccatcaagagcctgcagtggatggcgggcggcaccttcacgggggaggccctgcagtacacgcgggaccagctgctgccgcccagcccgaacaaccgcatcgccctggtcatcactgacgggcgctcagacactcagagggacaccacaccgctcaacgtgctctgcagccccggcatccaggtggtctccgtgggcatcaaagacgtgtttgacttcatcccaggctcagaccagctcaatgtcatttcttgccaaggcctggcaccatcccagggccggcccggcctctcgctggtcaaggagaactatgcagagctgctggaggatgccttcctgaagaatgtcaccgcccagatctgcatagacaagaagtgtccagattacacctgccccatcacgttctcctccccggctgacatcaccatcctgctggacggctccgccagcgtgggcagccacaactttgacaccaccaagcgcttcgccaagcgcctggccgagcgcttcctcacagcgggcaggacggaccccgcccacgacgtgcgggtggcggtggtgcagtacagcggcacgggccagcagcgcccagagcgggcgtcgctgcagttcctgcagaactacacggccctggccagtgccgtcgatgccatggactttatcaacgacgccaccgacgtcaacgatgccctgggctatgtgacccgcttctaccgcgaggcctcgtccggcgctgccaagaagaggctgctgctcttctcagatggcaactcgcagggcgccacgcccgctgccatcgagaaggccgtgcaggaagcccagcgggcaggcatcgagatcttcgtggtggtcgtgggccgccaggtgaatgagccccacatccgcgtcctggtcaccggcaagacggccgagtacgacgtggcctacggcgagagccacctgttccgtgtccccagctaccaggccctgctccgcggtgtcttccaccagacagtctccaggaaggtggcgctgggctagcccaccctgcacgccggcaccaaaccctgtcctcccacccctccccactcatcactaaacagagtaaaatgtgatgcgaattttcccgaccaacctgattcgctagattttttttaaggaaaagcttggaaagccaggacacaacgctgctgcctgctttgtgcagggtcctccggggctcagccctgagttggcatcacctgcgcagggccctctggggctcagccctgagctagtgtcacctgcacagggccctctgaggctcagccctgagctggcgtcacctgtgcagggccctctggggctcagccctgagctggcctcacctgggttccccaccccgggctctcctgccctgccctcctgcccgccctccctcctgcctgcgcagctccttccctaggcacctctgtgctgcatcccaccagcctgagcaagacgccctctcggggcctgtgccgcactagcctccctctcctctgtccccatagctggtttttcccaccaatcctcacctaacagttactttacaattaaactcaaagcaagctcttctcctcagcttggggcagccattggcctctgtctcgttttgggaaaccaaggtcaggaggccgttgcagacataaatctcggcgactcggccccgtctcctgagggtcctgctggtgaccggcctggaccttggccctacagccctggaggccgctgctgaccagcactgaccccgacctcagagagtactcgcaggggcgctggctgcactcaagaccctcgagattaacggtgctaaccccgtctgctcctccctcccgcagagactggggcctggactggacatgagagccccttggtgccacagagggctgtgtcttactagaaacaacgcaaacctctccttcctcagaatagtgatgtgttcgacgttttatcaaaggccccctttctatgttcatgttagttttgctccttctgtgtttttttctgaaccatatccatgttgctgacttttccaaataaaggttttcactcctctaaaaaaaaaaaaaaaaaaaaa

SEQ ID NO: 30 - protein, 1028 aa, Homo sapiens
MRAARALLPLLLQACWTAAQDEPETPRAVAFQDCPVDLFFVLDTSESVALRLKPYGALVDKVKSFTKRFIDNLRDRYYRCDRNLVWNAGALHYSDEVEIIQGLTRMPGGRDALKSSVDAVKYFGKGTYTDCAIKKGLEQLLVGGSHLKENKYLIVVTDGHPLEGYKEPCGGLEDAVNEAKHLGVKVFSVAITPDHLEPRLSIIATDHTYRRNFTAADWGQSRDAEEAISQTIDTIVDMIKNNVEQVCCSFECQPARGPPGLRGDPGFEGERGKPGLPGEKGEAGDPGRPGDLGPVGYQGMKGEKGSRGEKGSRGPKGYKGEKGKRGIDGVDGVKGEMGYPGLPGCKGSPGFDGIQGPPGPKGDPGAFGLKGEKGEPGADGEAGRPGSSGPSGDEGQPGEPGPPGEKGEAGDEGNPGPDGAPGERGGPGERGPRGTPGTRGPRGDPGEAGPQGDQGREGPVGVPGDPGEAGPIGPKGYRGDEGPPGSEGARGAPGPAGPPGDPGLMGERGEDGPAGNGTEGFPGFPGYPGNRGAPGINGTKGYPGLKGDEGEAGDPGDDNNDIAPRGVKGAKGYRGPEGPQGPPGHQGPPGPDECEILDIIMKMCSCCECKCGPIDLLFVLDSSESIGLQNFEIAKDFVVKVIDRLSRDELVKFEPGQSYAGVVQYSHSQMQEHVSLRSPSIRNVQELKEAIKSLQWMAGGTFTGEALQYTRDQLLPPSPNNRIALVITDGRSDTQRDTTPLNVLCSPGIQVVSVGIKDVFDFIPGSDQLNVISCQGLAPSQGRPGLSLVKENYAELLEDAFLKNVTAQICIDKKCPDYTCPITFSSPADITILLDGSASVGSHNFDTTKRFAKRLAERFLTAGRTDPAHDVRVAVVQYSGTGQQRPERASLQFLQNYTALASAVDAMDFINDATDVNDALGYVTRFYREASSGAAKKRLLLFSDGNSQGATPAAIEKAVQEAQRAGIEIFVVVVGRQVNEPHIRVLVTGKTAEYDVAYGESHLFRVPSYQALLRGVFHQTVSRKVALG

SEQ ID NO: 31 - DNA, 6668 bp, Homo sapiens
aggctggcgtccccgccccgaaagcactgggcccgccgcgtcgcaccgtcctctttcctttccttctccctccccttttcccttccttcgtcccttccttccttcctttcgccgggcgcgatggagccggggcgccggggggccgcggcgctgctagcgctgctgtgcgtggcctgcgcgctgcgcgccgggcgcgcccaatacgaacgctacagcttccgcagcttcccacgggacgagctgatgccgctcgagtcggcctaccggcacgcgctggacaagtacagcggcgagcactgggccgagagcgtgggctacctggagatcagcctgcggctgcaccgcttgctgcgcgacagcgaggccttctgccaccgcaactgcagcgccgcgccgcagcccgagcccgccgccggcctcgccagctatcccgagctgcgcctcttcgggggcctgctgcgccgcgcgcactgcctcaagcgctgcaagcagggcctgccagccttccgccagtcccagcccagccgcgaggtgctggcggacttccagcgccgcgagccctacaagttcctgcagttcgcttacttcaaggcaaataatctccccaaagccatcgccgctgctcacacctttctactgaagcatcctgatgacgaaatgatgaagaggaacatggcatattataagagcctgcctggtgccgaggactacattaaagacctggaaaccaagtcatatgaaagcctgttcatccgagcagtgcgggcatacaacggtgagaactggagaacatccatcacagacatggagctggcccttcccgacttcttcaaagccttttacgagtgtctcgcagcctgcgagggttccagggagatcaaggacttcaaggatttctacctttccatagcagatcattatgtagaagttctggaatgcaaaatacagtgtgaagagaacctcaccccagttataggaggctatccggttgagaaatttgtggctaccatgtatcattacttgcagtttgcctattataagttgaacgacctgaagaatgcagccccctgtgcagtcagctatctgctctttgatcagaatgacaaggtcatgcagcagaacctggtgtattaccagtaccacagggacacttggggcctctcggatgagcacttccagcccagacctgaagcagttcagttctttaatgtgaccacactccagaaggagctgtatgactttgctaaggaaaatataatggatgatgatgagggagaagttgtggaatatgtggatgacctcttggaactggaggagaccagctagcccacagcaaccaaagagacttcctcttggcgttcaggaaacacagattctttgtccttttcccaacagcccaggctgttgatacctcagagccttctctttactctccaaagtgaaagggaagcccccgtctctctaactgcatgtcatcaggggtgagcctgcctttcctatcttcacacctgccacctcatgttcacacctatctttctcaccttttttttgagatggagtctcgctctcttgcccaggctggagtgcaatggcacgttctcagctcactgcaacctccgcctcttgggttcaagcaattctgctgcatcagcctcccgagtacctgggattacaggcatgtgccaccacgcccggctaattttgtatttttagtagagacggggttttgccatgttggccaggctggtctcgaactcttgacttcagatgatccatctgccttggcctcccacagtgctgggattacaggcgtgagccaccatgcccggcctctttctcacctttacacctgtcttcttatcctcacatctgttttcacaccttcatccctgtcttcctcatgttcacacttgtcttccccatgttcatagctgcctttcttaccattttggtttgaagggcagtcttctctggcttgtttttttgtttttcccagaaaatcagtattattttttaaataagaaaaacattcctagaagatgataattgtgaaaacctcctttggcttatttgcttttccagattttagtctcctttctccccatccgggaaagatggtggaagacataggctaaatttctccagcctcacaatggtcttcacttggtctgacttgtaccaattctagcacccactgaaaaacaagttgagtagagagtgtagagtgcagaaatgtggcttttgccccactttgcatctccaaaattacaacggttggccgatcccatttgaggacaatgcttagttataagtctccgagttggaaaaggaagaaagccagagctgtctagtttcattcattctttcagtaaatatttattgagtacctactgtgtgctaggcattgacctgggaactagagatacttcacagaataacagggaaagttccctgtgctcatggagcttacattctacagggagaaagagatagccaatacataggaataaatatatacaaggtatcatgtagtgataattgctgtggagaaaaataaagcaggggagggagtaagaaatcctggagatgaggctgcagttttaaatggggcctcactgggaatgtgacgttgagcagagacgttagggaagtggatcctggacaaggcattccaggcagaggaacaggatgtgcactgccccaaagtgagaacttgctctacgtggtcaggaaagagcagggagaccaagcagagtcgtgggcaggggtagaatggaaggagaggcggctggggaggacaggtggtggagggccttggcttctgctaagtgagatgggaaccactggagggtttgaacagaggagtgccttgattgatttatattttgcaagggtcattctagctgccatattgtgaaaaactttagtggacaagggcagaaggaagagggaagacctgttaggaagctactgcaaggttccaggcttgggcctgggccacagcaacagcagtggtcaaatatctagatttattttgaaaagagccaataggatttgctgagagtttgaatgtggagtgtaagagaaggaagagttaatgatgacattaaggtttttggcctgaatagcaggaaagatggagttaccagttactgaaatagggaaggatgggctgggtaagtatggaatttggtgcaaagcaggctgtctgtggttggaatgggaggttctggctgcaaatcaaagtggagagttctctcaggtcaggtctgcagcagagctcgagacagggatctgaatgcacttggtttattgttgggggtgctctcagaaggaacctgtgaaagcctttatcagtcatttattggctgtgagaagttctctgggagtgtgggtacatttgaaggcaagtgacttcagttgagggcaagtctctggaaaagaggctgtaggcatctggcagctaccatgcatggtagtgtgttgggggtgggggtcctgggcactggctgtgtgaagggatctggcagggcaccacagcgccccctactgaaccatcagcatgtcagtggcatttaaagccatgcagctggaggggccactgagattgtctctgagtattactgagaagcaacagaaaagagccatggatggagcccttgggctctctgggaaatgggaaatcagccaaaggactgagaaggagttaccttaaggtcagagaaaaccaagagagtgtggtgttctggaagctgagctttctttattcaacctcattcccttctccaaataagccacttgtgtagttgggcccctccagggttgaaggcaagaggagaaaggcacagcgtttgggaaacaagacttttcctgcaatagcctgggaaggaataaaaggatagagtgtttgggtttttgtgtaatggtggttaattggggtggaacactcacacgttgtgctttttctgggcttcccttatcccccagaacactctaccaacctcggggaactcgggcacatccttctgtttctccttcagctctatcctgctttcctcatcccttctgacaccacgtcctcactcacctgcacaagaatccctgcatcaggttctcctttgagggtacccacccaggacagtcccctaccacttctgtcttgggctgaagttgcccacgtccacaaaatctgtactcccagcgggggtgtttggcccgaggagtcagtgttattactggtggatgcaccgtgtccacagcagcccccaatcccagcgatgcgtcagatcttacgtggcttcctgctgggggagatggccttcacccacgggatgccgggttctcctttctttcctcaccccaacctttactccaccagagaaacttccttttgaactcagtggggaagagggtgatgagacaggactagaaagtagtgggggacccagcgagtggacgccctgctccgggattcctgagtctgtaaatagtgtgcccagcagctgtgaactccccttatagcctcaggctgcagtgtccttcccagctgtgtgagaaaatgaaagccgacgtccacagggacccaggcagggttgggtgttgtgactcactccacctctgtgccctgcagaggtactgttgggtccttgtcttgtgagcctggggtgagctctctgtacatgttgttgttccacgtatgggttgacttggcatgctggggggtcctcgttcactctctgaagttggcctcctttcactggggattgaaaagcacctccacccctaccctagtgatgtcccctgaggacccgggtgatagtacagtcaatattgtcagtactttgctttgattgaaggctgtagagctgagttaccaaaatttctatttcaaaggaaaccaaaccttaaaaaaaaaaaacaaaaactgggctgggtcttccaaacctaccatgaaaccctggtgtgcaggctgcactcaatgacctcaacccaacacctccctgagtgtgcttcttggaagagcctagaagattcctggatggagaccccattggttcagcctcaagtctggcccgtcttcgaaaaaacaaacacatttgtaagctttgtgggagcttccaggcctgctctaagatgccttgcttgtcctttgacccatcagcatggagctcagtggttgctgtttggttctgcaggctggtggggaggccgcccatcgtggtggggcatctgtccagccccattgccactcagggcatccaaacaggaggcacccgctgggaagggtctaaagatactccttgtggccactgctactgttcacacttgacttgtggagaagcgaagggctgaggggaggtttgtgtacacccatgtatttaaaagtgactgactgactgaaatgagcacataccgacatatgcaacatactaataccttcctgattttcgagactttctaattactacaactaacctgttgtgctcacctctggaattcagaaagagagccactgcgagcactgaccacaagggctgccttaggaaggaaatgtgtgctttcaggagttcttattaggggaattttaagagcacaaaaattttattgaacccaccttagtgacaaacagaaaatgatttgttagattgtcagttggaaggggtttattatgactgctggtgaaataaacagtgaccagtttctgccaacatttatggaaataacgtttctaggttttaaatgtgagccgtaaactgaagctacttcagttaaaaaaaaaaaaatcaatacttaaactgtagggaaaaggtggattggtgccagagaaaacattatttaatagtgtcagaacatggaactgcaacacagtttgtagcaaggcactgagaaaaacccacaactaatccttcatcgcagctgtctgaactcttgatcatctgccatcccccaaacagtgacttctttttttctggtgactccaggcctgaatgacctagtgtggagagtttaaactatgtacaagggaggaaagaaaaaaaggaaaggaaccttaagtaagcctcagccaaaggttttatgcattggacttcctgtgcctgcccccaggggcaagactgatccccatgcctgtgcccatgacatctccctgaaagaggacaccatgacagcccggctttgccttgactgacccactgctaccccagaaataagaatcaagagcagctattgttatccttagagtgttttccgtctagggccggctcgtgaacagccacatatccttgcacctgacactgtccccacacaaatagctggctttcgttgcttgttgaatgaatgagtgagttggctctatatccccttggagctggccggtaagatattagtgcctcattttacaagaagagaataggaaggaattaagcaatttggccaacagatacaagatagattccagagttttatctcccactttagggtggcagccagtaggccaaactccaaagaccgttgctgatgtctttttctgcctcccctctttgggttagtgtggtatgtacaagctcactcttgttgaaaattagaaaatagttgaaaacaaaaggtttttgtttttctttttaaatcacattaaatgttttacattgcttaaaaaaaaaaaaaaaaaa

SEQ ID NO: 32 - protein, 401 aa, Homo sapiens
MEPGRRGAAALLALLCVACALRAGRAQYERYSFRSFPRDELMPLESAYRHALDKYSGEHWAESVGYLEISLRLHRLLRDSEAFCHRNCSAAPQPEPAAGLASYPELRLFGGLLRRAHCLKRCKQGLPAFRQSQPSREVLADFQRREPYKFLQFAYFKANNLPKAIAAAHTFLLKHPDDEMMKRNMAYYKSLPGAEDYIKDLETKSYESLFIRAVRAYNGENWRTSITDMELALPDFFKAFYECLAACEGSREIKDFKDFYLSIADHYVEVLECKIQCEENLTPVIGGYPVEKFVATMYHYLQFAYYKLNDLKNAAPCAVSYLLFDQNDKVMQQNLVYYQYHRDTWGLSDEHFQPRPEAVQFFNVTTLQKELYDFAKENIMDDDEGEVVEYVDDLLELEETS

SEQ ID NO: 33 - DNA, 2333 bp, Homo sapiens
agtaggacccaggggccgggaggcgccggcagagggaggggccgggggccggggaggttttgagggaggtctttggctttttttggcggagctggggcgccctccggaagcgtttccaactttccagaagtttctcgggacgggcaggagggggtggggactgccatatatagatcccgggagcaggggagcgggctaagagtagaatcgtgtcgcggctcgagagcgagagtcacgtcccggcgctagcccagcccgacccagaatgaaaaaggcaggcattgacctccctctgaggcagtttccaggcccaccgtggtgcacgcaaaccacttcctggccatgcgctccctcctgcttctcagcgccttctgcctcctggaggcggccctggccgccgaggtgaagaaacctgcagccgcagcagctcctggcactgcggagaagttgagccccaaggcggccacgcttgccgagcgcagcgccggcctggccttcagcttgtaccaggccatggccaaggaccaggcagtggagaacatcctggtgtcacccgtggtggtggcctcgtcgctagggctcgtgtcgctgggcggcaaggcgaccacggcgtcgcaggccaaggcagtgctgagcgccgagcagctgcgcgacgaggaggtgcacgccggcctgggcgagctgctgcgctcactcagcaactccacggcgcgcaacgtgacctggaagctgggcagccgactgtacggacccagctcagtgagcttcgctgatgacttcgtgcgcagcagcaagcagcactacaactgcgagcactccaagatcaacttccgcgacaagcgcagcgcgctgcagtccatcaacgagtgggccgcgcagaccaccgacggcaagctgcccgaggtcaccaaggacgtggagcgcacggacggcgccctgctagtcaacgccatgttcttcaagccacactgggatgagaaattccaccacaagatggtggacaaccgtggcttcatggtgactcggtcctataccgtgggtgtcatgatgatgcaccggacaggcctctacaactactacgacgacgagaaggaaaagctgcaaatcgtggagatgcccctggcccacaagctctccagcctcatcatcctcatgccccatcacgtggagcctctcgagcgccttgaaaagctgctaaccaaagagcagctgaagatctggatggggaagatgcagaagaaggctgttgccatctccttgcccaagggtgtggtggaggtgacccatgacctgcagaaacacctggctgggctgggcctgactgaggccattgacaagaacaaggccgacttgtcacgcatgtcaggcaagaaggacctgtacctggccagcgtgttccacgccaccgcctttgagttggacacagatggcaacccctttgaccaggacatctacgggcgcgaggagctgcgcagccccaagctgttctacgccgaccaccccttcatcttcctagtgcgggacacccaaagcggctccctgctattcattgggcgcctggtccggcctaagggtgacaagatgcgagacgagttatagggcctcagggtgcacacaggatggcaggaggcatccaaaggctcctgagacacatgggtgctattggggttgggggggaggtgaggtaccagccttggatactccatggggtgggggtggaaaaacagaccggggttcccgtgtgcctgagcggaccttcccagctagaattcactccacttggacatgggccccagataccatgatgctgagcccggaaactccacatcctgtgggacctgggccatagtcattctgcctgccctgaaagtcccagatcaagcctgcctcaatcagtattcatatttatagccaggtaccttctcacctgtgagaccaaattgagctaggggggtcagccagccctcttctgacactaaaacacctcagctgcctccccagctctatcccaacctctcccaactataaaactaggtgctgcagcccctgggaccaggcacccccagaatgacctggccgcagtgaggcggattgagaaggagctcccaggaggggcttctgggcagactctggtcaagaagcatcgtgtctggcgttgtggggatgaactttttgttttgtttcttccttttttagttcttcaaagatagggagggaagggggaacatgagcctttgttgctatcaatccaagaacttatttgtacattttttttttcaataaaacttttccaatgacattttgttggagcgtggaagaaaaaaaaaaaaaaa

SEQ ID NO: 34 - protein, 418 aa, Homo sapiens
MRSLLLLSAFCLLEAALAAEVKKPAAAAAPGTAEKLSPKAATLAERSAGLAFSLYQAMAKDQAVENILVSPVVVASSLGLVSLGGKATTASQAKAVLSAEQLRDEEVHAGLGELLRSLSNSTARNVTWKLGSRLYGPSSVSFADDFVRSSKQHYNCEHSKINFRDKRSALQSINEWAAQTTDGKLPEVTKDVERTDGALLVNAMFFKPHWDEKFHHKMVDNRGFMVTRSYTVGVMMMHRTGLYNYYDDEKEKLQIVEMPLAHKLSSLIILMPHHVEPLERLEKLLTKEQLKIWMGKMQKKAVAISLPKGVVEVTHDLQKHLAGLGLTEAIDKNKADLSRMSGKKDLYLASVFHATAFELDTDGNPFDQDIYGREELRSPKLFYADHPFIFLVRDTQSGSLLFIGRLVRPKGDKMRDEL

SEQ ID NO: 35 - DNA, 3879 bp, Homo sapiens
atcagacgcgcagaggaggcggggccgcggctggtttcctgccggggggcggctctgggccgccgagtcccctcctcccgcccctgaggaggaggagccgccgccacccgccgcgcccgacacccgggaggccccgccagcccgcgggagaggcccagcgggagtcgcggaacagcaggcccgagcccaccgcgccgggccccggacgccgcgcggaaaagatgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggcgtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttactcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgctaaaaagtccttgatttagcactatttacatacaggccatactttacaaagtatttgctgaatggggaccttttgagttgaatttattttattatttttattttgtttaatgtctggtgctttctgtcacctcttctaatcttttaatgtatttgtttgcaattttggggtaagactttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaagttatttattaaatatgcctaaaatacttaaatcggatgtcttgactctgatgtattttatcaggttgtgtgcatgaaatttttatagattaaagaagttgaggaaaagcaaaaaaaaaa

SEQ ID NO: 36 - protein, 798 aa, Homo sapiens
MNLQPIFWIGLISSVCCVFAQTDENRCLKANAKSCGECIQAGPNCGWCTNSTFLQEGMPTSARCDDLEALKKKGCPPDDIENPRGSKDIKKNKNVTNRSKGTAEKLKPEDITQIQPQQLVLRLRSGEPQTFTLKFKRAEDYPIDLYYLMDLSYSMKDDLENVKSLGTDLMNEMRRITSDFRIGFGSFVEKTVMPYISTTPAKLRNPCTSEQNCTSPFSYKNVLSLTNKGEVFNELVGKQRISGNLDSPEGGFDAIMQVAVCGSLIGWRNVTRLLVFSTDAGFHFAGDGKLGGIVLPNDGQCHLENNMYTMSHYYDYPSIAHLVQKLSENNIQTIFAVTEEFQPVYKELKNLIPKSAVGTLSANSSNVIQLIIDAYNSLSSEVILENGKLSEGVTISYKSYCKNGVNGTGENGRKCSNISIGDEVQFEISITSNKCPKKDSDSFKIRPLGFTEEVEVILQYICECECQSEGIPESPKCHEGNGTFECGACRCNEGRVGRHCECSTDEVNSEDMDAYCRKENSSEICSNNGECVCGQCVCRKRDNTNEIYSGKFCECDNFNCDRSNGLICGGNGVCKCRVCECNPNYTGSACDCSLDTSTCEASNGQICNGRGICECGVCKCTDPKFQGQTCEMCQTCLGVCAEHKECVQCRAFNKGEKKDTCTQECSYFNITKVESRDKLPQPVQPDPVSHCKEKDVDDCWFYFTYSVNGNNEVMVHVVENPECPTGPDIIPIVAGVVAGIVLIGLALLLIWKLLMIIHDRREFAKFEKEKMNAKWDTGENPIYKSAVTTVVNPKYEGK

SEQ ID NO: 37 - DNA, 2888 bp, Homo sapiens
cccgagcctctctccctggccaggccccaggtctcgcagccagggatggagatggggggagggggaacctagagttctttgtagtgcctccctcagactctaacacactcagcctggccccctcctcctattgcaaccccctcccccgctcctcccggccaggccagctcagtcttcccagcccccattccacgtggaccagccagggcgggggtagggaaagaggacaggaagagggggagccagttctgggaggcggggggaaggaggttggtggcgactccctcgctcgccctcactgccggcggtcccaactccaggcaccatgttccccgcgggcccccccagccacagcctcctccggctccccctgctgcagttgctgctactggtggtgcaggccgtggggagggggctgggccgcgccagcccggccgggggccccctggaagatgtggtcatcgagaggtaccacatccccagggcctgtccccgggaagtgcagatgggggattttgtgcgctaccactacaacggcacttttgaagatggcaagaagtttgattcaagctatgatcgcaacaccttggtggccatcgtggtgggtgtggggcgcctcatcactggcatggaccgaggcctcatgggcatgtgtgtcaacgagcggcgacgcctcattgtgcctccccacctgggctatgggagcatcggcctggcggggctcattccaccggatgccaccctctacttcgatgtggttctgctggatgtgtggaacaaggaagacaccgtgcaggtgagcacattgctgcgcccgccccactgcccccgcatggtccaggacggcgactttgtccgctaccactacaatggcaccctgctggacggcacctccttcgacaccagctacagtaagggcggcacttatgacacctacgtcggctctggttggctgatcaagggcatggaccaggggctgctgggcatgtgtcctggagagagaaggaagattatcatccctccattcctggcctatggcgagaaaggctatgggacagtgatccccccacaggcctcgctggtctttcacgtcctcctgattgacgtgcacaacccgaaggacgctgtccagctagagacgctggagctcccccccggctgtgtccgcagagccggggccggggacttcatgcgctaccactacaatggctccttgatggacggcaccctcttcgattccagctactcccgcaaccacacctacaatacctatatcgggcagggttacatcatccccgggatggaccaggggctgcagggtgcctgcatgggggaacgccggagaattaccatccccccgcacctcgcctatggggagaatggaactggagacaagatccctggctctgccgtgctaatcttcaacgtccatgtcattgacttccacaaccctgcggatgtggtggaaatcaggacactgtcccggccatctgagacctgcaatgagaccaccaagcttggggactttgttcgataccattacaactgttctttgctggacggcacccagctgttcacctcgcatgactacggggccccccaggaggcgactctcggggccaacaaggtgatcgaaggcctggacacgggcctgcagggcatgtgtgtgggagagaggcggcagctcatcgtgcccccgcacctggcccacggggagagtggagcccggggagtcccaggcagtgctgtgctgctgtttgaggtggagctggtgtcccgggaggatgggctgcccacaggctacctgtttgtgtggcacaaggaccctcctgccaacctgtttgaagacatggacctcaacaaggatggcgaggtccctccggaggagttctccaccttcatcaaggctcaagtgagtgagggcaaaggacgcctcatgcctgggcaggaccctgagaaaaccataggagacatgttccagaaccaggaccgcaaccaggacggcaagatcacagtcgacgagctcaagctgaagtcagatgaggacgaggagcgggtccacgaggagctctgaggggcagggagcctggccaggcctgagacacagaggcccactgcgagggggacagtggcggtgggactgacctgctgacagtcaccctccctctgctgggatgaggtccaggagccaactaaaacaatggcagaggagacatctctggtgttcccaccaccctagatgaaaatccacagcacagacctctaccgtgtttctcttccatccctaaaccacttccttaaaatgtttggatttgcaaagccaatttggggcctgtggagcctggggttggatagggccatggctggtcccccaccatacctcccctccacatcactgacacagctgagcttgttatccatctccccaaactttctctttctttgtacttcttgtcatccccactcccagccccttttcctctatgtgacagctccctaggacccctctgccttcctccccaatcctgactggctcctagggaaggggaaggctcctggagggcagccctacctctcccatgccctttgccctcctccctcgcctccagtggaggctgagctgaccctgggctgctggaggccagactgggctgtagttagcttttcatccctaaagaaggctcctttccctaaggaaccatagaagagaggaagaaaacaaagggcatgtgtgagggaagctgcttgggtgggtgttagggctatgaaatcttggatttggggctgaggggtgggagggagggcagagctctgcacactcaaaggctaaactggtgtcagtccttttttcctttgttccaaataaaagattaaaccaatggcaaaaa

SEQ ID NO: 38 - protein, 582 aa, Homo sapiens
MFPAGPPSHSLLRLPLLQLLLLVVQAVGRGLGRASPAGGPLEDVVIERYHIPRACPREVQMGDFVRYHYNGTFEDGKKFDSSYDRNTLVAIVVGVGRLITGMDRGLMGMCVNERRRLIVPPHLGYGSIGLAGLIPPDATLYFDVVLLDVWNKEDTVQVSTLLRPPHCPRMVQDGDFVRYHYNGTLLDGTSFDTSYSKGGTYDTYVGSGWLIKGMDQGLLGMCPGERRKIIIPPFLAYGEKGYGTVIPPQASLVFHVLLIDVHNPKDAVQLETLELPPGCVRRAGAGDFMRYHYNGSLMDGTLFDSSYSRNHTYNTYIGQGYIIPGMDQGLQGACMGERRRITIPPHLAYGENGTGDKIPGSAVLIFNVHVIDFHNPADVVEIRTLSRPSETCNETTKLGDFVRYHYNCSLLDGTQLFTSHDYGAPQEATLGANKVIEGLDTGLQGMCVGERRQLIVPPHLAHGESGARGVPGSAVLLFEVELVSREDGLPTGYLFVWHKDPPANLFEDMDLNKDGEVPPEEFSTFIKAQVSEGKGRLMPGQDPEKTIGDMFQNQDRNQDGKITVDELKLKSDEDEERVHEEL

SEQ ID NO: 39 - DNA, 8449 bp, Homo sapiens
gcccgcgccggctgtgctgcacagggggaggagagggaaccccaggcgcgagcgggaagaggggacctgcagccacaacttctctggtcctctgcatcccttctgtccctccacccgtccccttccccaccctctggcccccaccttcttggaggcgacaacccccgggaggcattagaagggatttttcccgcaggttgcgaagggaagcaaacttggtggcaacttgcctcccggtgcgggcgtctctcccccaccgtctcaacatgcttaggggtccggggcccgggctgctgctgctggccgtccagtgcctggggacagcggtgccctccacgggagcctcgaagagcaagaggcaggctcagcaaatggttcagccccagtccccggtggctgtcagtcaaagcaagcccggttgttatgacaatggaaaacactatcagataaatcaacagtgggagcggacctacctaggcaatgcgttggtttgtacttgttatggaggaagccgaggttttaactgcgagagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggctgaagacacaaggaaataagcaaatgctttgcacgtgcctgggcaacggagtcagctgccaagagacagctgtaacccagacttacggtggcaactcaaatggagagccatgtgtcttaccattcacctacaatggcaggacgttctactcctgcaccacagaagggcgacaggacggacatctttggtgcagcacaacttcgaattatgagcaggaccagaaatactctttctgcacagaccacactgttttggttcagactcgaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctaaaaattctgtaggccgttggaaggaagctaccataccaggccacttaaactcctacaccatcaaaggcctgaagcctggtgtggtatacgagggccagctcatcagcatccagcagtacggccaccaagaagtgactcgctttgacttcaccaccaccagcaccagcacacctgtgaccagcaacaccgtgacaggagagacgactcccttttctcctcttgtggccacttctgaatctgtgaccgaaatcacagccagtagctttgtggtctcctgggtctcagcttccgacaccgtgtcgggattccgggtggaatatgagctgagtgaggagggagatgagccacagtacctggatcttccaagcacagccacttctgtgaacatccctgacctgcttcctggccgaaaatacattgtaaatgtctatcagatatctgaggatggggagcagagtttgatcctgtctacttcacaaacaacagcgcctgatgcccctcctgacccgactgtggaccaagttgatgacacctcaattgttgttcgctggagcagaccccaggctcccatcacagggtacagaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcaacaagaaaccactggcaccccacgctcagatacagtgccctctcccagggacctgcagtttgtggaagtgacagacgtgaaggtcaccatcatgtggacaccgcctgagagtgcagtgaccggctaccgtgtggatgtgatccccgtcaacctgcctggcgagcacgggcagaggctgcccatcagcaggaacacctttgcagaagtcaccgggctgtcccctggggtcacctattacttcaaagtctttgcagtgagccatgggagggagagcaagcctctgactgctcaacagacaaccaaactggatgctcccactaacctccagtttgtcaatgaaactgattctactgtcctggtgagatggactccacctcgggcccagataacaggataccgactgaccgtgggccttacccgaagaggacagcccaggcagtacaatgtgggtccctctgtctccaagtacccactgaggaatctgcagcctgcatctgagtacaccgtatccctcgtggccataaagggcaaccaagagagccccaaagccactggagtctttaccacactgcagcctgggagctctattccaccttacaacaccgaggtgactgagaccaccattgtgatcacatggacgcctgctccaagaattggttttaagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacaccattgtctccaccaacaaacttgcatctggaggcaaaccctgacactggagtgctcacagtctcctgggagaggagcaccaccccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccagctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaaatctcctgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacagtttctgatgttccgagggacctggaagttgttgctgcgacccccaccagcctactgatcagctgggatgctcctgctgtcacagtgagatattacaggatcacttacggagagacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccaacattgatcgccctaaaggactggcattcactgatgtggatgtcgattccatcaaaattgcttgggaaagcccacaggggcaagtttccaggtacagggtgacctactcgagccctgaggatggaatccatgagctattccctgcacctgatggtgaagaagacactgcagagctgcaaggcctcagaccgggttctgagtacacagtcagtgtggttgccttgcacgatgatatggagagccagcccctgattggaacccagtccacagctattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacagacgagcttccccaactggtaacccttccacaccccaatcttcatggaccagagatcttggatgttccttccacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacatcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccacaacttgaagttcatctatttgatataagacaccttcgggggaaataattcctgtgaatattctttttcaattcagcaaacatttgaaaatctatgatgtgcaagtctaattgttgatttcagtacaagattttctaaatcagttgctacaaaaactgattggtttttgtcacttcatctcttcactaatggagatagctttacactttctgctttaatagatttaagtggaccccaatatttattaaaattgctagtttaccgttcagaagtataatagaaataatctttagttgctcttttctaaccattgtaattcttcccttcttccctccacctttccttcattgaataaacctctgttcaaagagattgcctgcaagggaaataaaaatgactaagatattaaaaaaaaaaaaaaaaaa

SEQ ID NO: 40 - protein, 2355 aa, Homo sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDPTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTNIDRPKGLAFTDVDVDSIKIAWESPQGQVSRYRVTYSSPEDGIHELFPAPDGEEDTAELQGLRPGSEYTVSVVALHDDMESQPLIGTQSTAIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTDELPQLVTLPHPNLHGPEILDVPSTVQKTPFVTHPGYDTGNGIQLPGTSGQQPSVGQQMIFEEHGFRRTTPPTTATPIRHRPRPYPPNVGQEALSQTTISWAPFQDTSEYIISCHPVGTDEEPLQFRVPGTSTSATLTGLTRGATYNIIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 41 - DNA, 850 bp, Homo sapiens
gcgccccgcccctgagccggccgcccagcccccagtggggttcccggcgcggggaatgtcccgggtggagctggctgagtcgcgcgctctgctccacccgacggggctgtgtgtgctgggcctggctcgcggcgaaccgagatggcagagcagtcggacgaggccgtgaagtactacaccctagaggagattcagaagcacaaccacagcaagagcacctggctgatcctgcaccacaaggtgtacgatttgaccaaatttctggaagagcatcctggtggggaagaagttttaagggaacaagctggaggtgacgctactgagaactttgaggatgtcgggcactctacagatgccagggaaatgtccaaaacattcatcattggggagctccatccagatgacagaccaaagttaaacaagcctccggaaactcttatcactactattgattctagttccagttggtggaccaactgggtgatccctgccatctctgcagtggccgtcgccttgatgtatcgcctatacatggcagaggactgaacacctcctcagaagtcagcgcaggaagagcctgctttggacacgggagaaaagaagccattgctaactacttcaactgacagaaaccttcacttgaaaacaatgattttaatatatctctttctttttcttccgacattagaaacaaaacaaaaagaactgtcctttctgcgctcaaatttttcgagtgtgcctttttattcatctactttattttgatgtttccttaatgtgtaatttacttattataagcatgatcttttaaaaatatatttggcttttaaagtatgcaaaaaaaaaaaaa

SEQ ID NO: 42 - protein, 134 aa, Homo sapiens
MAEQSDEAVKYYTLEEIQKHNHSKSTWLILHHKVYDLTKFLEEHPGGEEVLREQAGGDATENFEDVGHSTDAREMSKTFIIGELHPDDRPKLNKPPETLITTIDSSSSWWTNWVIPAISAVAVALMYRLYMAED

SEQ ID NO: 43 - DNA, 874 bp, Homo sapiens
gcgccccgcccctgagccggccgcccagcccccagtggggttcccggcgcggggaatgtcccgggtggagctggctgagtcgcgcgctctgctccacccgacggggctgtgtgtgctgggcctggctcgcggcgaaccgagatggcagagcagtcggacgaggccgtgaagtactacaccctagaggagattcagaagcacaaccacagcaagagcacctggctgatcctgcaccacaaggtgtacgatttgaccaaatttctggaagagcatcctggtggggaagaagttttaagggaacaagctggaggtgacgctactgagaactttgaggatgtcgggcactctacagatgccagggaaatgtccaaaacattcatcattggggagctccatccagatgacagaccaaagttaaacaagcctccggaaccttaaaggcggtgtttcaaggaaactcttatcactactattgattctagttccagttggtggaccaactgggtgatccctgccatctctgcagtggccgtcgccttgatgtatcgcctatacatggcagaggactgaacacctcctcagaagtcagcgcaggaagagcctgctttggacacgggagaaaagaagccattgctaactacttcaactgacagaaaccttcacttgaaaacaatgattttaatatatctctttctttttcttccgacattagaaacaaaacaaaaagaactgtcctttctgcgctcaaatttttcgagtgtgcctttttattcatctactttattttgatgtttccttaatgtgtaatttacttattataagcatgatcttttaaaaatatatttggcttttaaagtatgcaaaaaaaaaaaaa

SEQ ID NO: 44 - protein, 98 aa, Homo sapiens
MAEQSDEAVKYYTLEEIQKHNHSKSTWLILHHKVYDLTKFLEEHPGGEEVLREQAGGDATENFEDVGHSTDAREMSKTFIIGELHPDDRPKLNKPPEP

SEQ ID NO: 45 - DNA, 820 bp, Homo sapiens
gcgccccgcccctgagccggccgcccagcccccagtggggttcccggcgcggggaatgtcccgggtggagctggctgagtcgcgcgctctgctccacccgacggggctgtgtgtgctgggcctggctcgcggcgaaccgagatggcagagcagtcggacgaggccgtgaagtactacaccctagaggagattcagaagcacaaccacagcaagagcacctggctgatcctgcaccacaaggtgtacgatttgaccaaatttctggaagagcatcctggtggggaagaagttttaagggaacaagctggaggtgacgctactgagaactttgaggatgtcgggcactctacagatgccagggaaatgtccaaaacattcatcattggggagctccatccagaaactcttatcactactattgattctagttccagttggtggaccaactgggtgatccctgccatctctgcagtggccgtcgccttgatgtatcgcctatacatggcagaggactgaacacctcctcagaagtcagcgcaggaagagcctgctttggacacgggagaaaagaagccattgctaactacttcaactgacagaaaccttcacttgaaaacaatgattttaatatatctctttctttttcttccgacattagaaacaaaacaaaaagaactgtcctttctgcgctcaaatttttcgagtgtgcctttttattcatctactttattttgatgtttccttaatgtgtaatttacttattataagcatgatcttttaaaaatatatttggcttttaaagtatgcaaaaaaaaaaaaa

SEQ ID NO: 46 - protein, 124 aa, Homo sapiens
MAEQSDEAVKYYTLEEIQKHNHSKSTWLILHHKVYDLTKFLEEHPGGEEVLREQAGGDATENFEDVGHSTDAREMSKTFIIGELHPETLITTIDSSSSWWTNWVIPAISAVAVALMYRLYMAED

SEQ ID NO: 47 - DNA, 3207 bp, Homo sapiens
ggcccacagaggagcacagctgtgtttggctgcagggccaagagcgctgtcaagaagacccacacgcccccctccagcagctgaattcctgcagctcagcagccgccgccagagcaggacgaaccgccaatcgcaaggcacctctgagaacttcaggatgcagatgtctccagccctcacctgcctagtcctgggcctggcccttgtctttggtgaagggtctgctgtgcaccatcccccatcctacgtggcccacctggcctcagacttcggggtgagggtgtttcagcaggtggcgcaggcctccaaggaccgcaacgtggttttctcaccctatggggtggcctcggtgttggccatgctccagctgacaacaggaggagaaacccagcagcagattcaagcagctatgggattcaagattgatgacaagggcatggcccccgccctccggcatctgtacaaggagctcatggggccatggaacaaggatgagatcagcaccacagacgcgatcttcgtccagcgggatctgaagctggtccagggcttcatgccccacttcttcaggctgttccggagcacggtcaagcaagtggacttttcagaggtggagagagccagattcatcatcaatgactgggtgaagacacacacaaaaggtatgatcagcaacttgcttgggaaaggagccgtggaccagctgacacggctggtgctggtgaatgccctctacttcaacggccagtggaagactcccttccccgactccagcacccaccgccgcctcttccacaaatcagacggcagcactgtctctgtgcccatgatggctcagaccaacaagttcaactatactgagttcaccacgcccgatggccattactacgacatcctggaactgccctaccacggggacaccctcagcatgttcattgctgccccttatgaaaaagaggtgcctctctctgccctcaccaacattctgagtgcccagctcatcagccactggaaaggcaacatgaccaggctgccccgcctcctggttctgcccaagttctccctggagactgaagtcgacctcaggaagcccctagagaacctgggaatgaccgacatgttcagacagtttcaggctgacttcacgagtctttcagaccaagagcctctccacgtcgcgcaggcgctgcagaaagtgaagatcgaggtgaacgagagtggcacggtggcctcctcatccacagctgtcatagtctcagcccgcatggcccccgaggagatcatcatggacagacccttcctctttgtggtccggcacaaccccacaggaacagtccttttcatgggccaagtgatggaaccctgaccctggggaaagacgccttcatctgggacaaaactggagatgcatcgggaaagaagaaactccgaagaaaagaattttagtgttaatgactctttctgaaggaagagaagacatttgccttttgttaaaagatggtaaaccagatctgtctccaagaccttggcctctccttggaggacctttaggtcaaactccctagtctccacctgagaccctgggagagaagtttgaagcacaactcccttaaggtctccaaaccagacggtgacgcctgcgggaccatctggggcacctgcttccacccgtctctctgcccactcgggtctgcagacctggttcccactgaggccctttgcaggatggaactacggggcttacaggagcttttgtgtgcctggtagaaactatttctgttccagtcacattgccatcactcttgtactgcctgccaccgcggaggaggctggtgacaggccaaaggccagtggaagaaacaccctttcatctcagagtccactgtggcactggccacccctccccagtacaggggtgctgcaggtggcagagtgaatgtcccccatcatgtggcccaactctcctggcctggccatctccctccccagaaacagtgtgcatgggttattttggagtgtaggtgacttgtttactcattgaagcagatttctgcttccttttatttttataggaatagaggaagaaatgtcagatgcgtgcccagctcttcaccccccaatctcttggtggggaggggtgtacctaaatatttatcatatccttgcccttgagtgcttgttagagagaaagagaactactaaggaaaataatattatttaaactcgctcctagtgtttctttgtggtctgtgtcaccgtatctcaggaagtccagccacttgactggcacacacccctccggacatccagcgtgacggagcccacactgccaccttgtggccgcctgagaccctcgcgccccccgcgcccctctttttccccttgatggaaattgaccatacaatttcatcctccttcaggggatcaaaaggacggagtggggggacagagactcagatgaggacagagtggtttccaatgtgttcaatagatttaggagcagaaatgcaaggggctgcatgacctaccaggacagaactttccccaattacagggtgactcacagccgcattggtgactcacttcaatgtgtcatttccggctgctgtgtgtgagcagtggacacgtgaggggggggtgggtgagagagacaggcagctcggattcaactaccttagataatatttctgaaaacctaccagccagagggtagggcacaaagatggatgtaatgcactttgggaggccaaggcgggaggattgcttgagcccaggagttcaagaccagcctgggcaacataccaagacccccgtctctttaaaaatatatatattttaaatatacttaaatatatatttctaatatctttaaatatatatatatattttaaagaccaatttatgggagaattgcacacagatgtgaaatgaatgtaatctaatagaagcctaatcagcccaccatgttctccactgaaaaatcctctttctttggggtttttctttctttcttttttgattttgcactggacggtgacgtcagccatgtacaggatccacaggggtggtgtcaaatgctattgaaattgtgttgaattgtatgctttttcacttttgataaataaacatgtaaaaatgtttcaaaaaaataataaaataaataaatacgaagaatatgtcaggacagtcaaaaaaaaaaaaaaaaaa

SEQ ID NO: 48 - protein, 402 aa, Homo sapiens [sequence omitted]

SEQ ID NO: 49 - DNA, 3162 bp, Homo sapiens
ggcccacagaggagcacagctgtgtttggctgcagggccaagagcgctgtcaagaagacccacacgcccccctccagcagctgaattcctgcagctcagcagccgccgccagagcaggacgaaccgccaatcgcaaggcacctctgagaacttcaggatgcagatgtctccagccctcacctgcctagtcctgggcctggcccttgtctttggtgaagggtctgctgtgcaccatcccccatcctacgtggcgcaggcctccaaggaccgcaacgtggttttctcaccctatggggtggcctcggtgttggccatgctccagctgacaacaggaggagaaacccagcagcagattcaagcagctatgggattcaagattgatgacaagggcatggcccccgccctccggcatctgtacaaggagctcatggggccatggaacaaggatgagatcagcaccacagacgcgatcttcgtccagcgggatctgaagctggtccagggcttcatgccccacttcttcaggctgttccggagcacggtcaagcaagtggacttttcagaggtggagagagccagattcatcatcaatgactgggtgaagacacacacaaaaggtatgatcagcaacttgcttgggaaaggagccgtggaccagctgacacggctggtgctggtgaatgccctctacttcaacggccagtggaagactcccttccccgactccagcacccaccgccgcctcttccacaaatcagacggcagcactgtctctgtgcccatgatggctcagaccaacaagttcaactatactgagttcaccacgcccgatggccattactacgacatcctggaactgccctaccacggggacaccctcagcatgttcattgctgccccttatgaaaaagaggtgcctctctctgccctcaccaacattctgagtgcccagctcatcagccactggaaaggcaacatgaccaggctgccccgcctcctggttctgcccaagttctccctggagactgaagtcgacctcaggaagcccctagagaacctgggaatgaccgacatgttcagacagtttcaggctgacttcacgagtctttcagaccaagagcctctccacgtcgcgcaggcgctgcagaaagtgaagatcgaggtgaacgagagtggcacggtggcctcctcatccacagctgtcatagtctcagcccgcatggcccccgaggagatcatcatggacagacccttcctctttgtggtccggcacaaccccacaggaacagtccttttcatgggccaagtgatggaaccctgaccctggggaaagacgccttcatctgggacaaaactggagatgcatcgggaaagaagaaactccgaagaaaagaattttagtgttaatgactctttctgaaggaagagaagacatttgccttttgttaaaagatggtaaaccagatctgtctccaagaccttggcctctccttggaggacctttaggtcaaactccctagtctccacctgagaccctgggagagaagtttgaagcacaactcccttaaggtctccaaaccagacggtgacgcctgcgggaccatctggggcacctgcttccacccgtctctctgcccactcgggtctgcagacctggttcccactgaggccctttgcaggatggaactacggggcttacaggagcttttgtgtgcctggtagaaactatttctgttccagtcacattgccatcactcttgtactgcctgccaccgcggaggaggctggtgacaggccaaaggccagtggaagaaacaccctttcatctcagagtccactgtggcactggccacccctccccagtacaggggtgctgcaggtggcagagtgaatgtcccccatcatgtggcccaactctcctggcctggccatctccctccccagaaacagtgtgcatgggttattttggagtgtaggtgacttgtttactcattgaagcagatttctgcttccttttatttttataggaatagaggaagaaatgtcagatgcgtgcccagctcttcaccccccaatctcttggtggggaggggtgtacctaaatatttatcatatccttgcccttgagtgcttgttagagagaaagagaactactaaggaaaataatattatttaaactcgctcctagtgtttctttgtggtctgtgtcaccgtatctcaggaagtccagccacttgactggcacacacccctccggacatccagcgtgacggagcccacactgccaccttgtggccgcctgagaccctcgcgccccccgcgcccctctttttccccttgatggaaattgaccatacaatttcatcctccttcaggggatcaaaaggacggagtggggggacagagactcagatgaggacagagtggtttccaatgtgttcaatagatttaggagcagaaatgcaaggggctgcatgacctaccaggacagaactttccccaattacagggtgactcacagccgcattggtgactcacttcaatgtgtcatttccggctgctgtgtgtgagcagtggacacgtgaggggggggtgggtgagagagacaggcagctcggattcaactaccttagataatatttctgaaaacctaccagccagagggtagggcacaaagatggatgtaatgcactttgggaggccaaggcgggaggattgcttgagcccaggagttcaagaccagcctgggcaacataccaagacccccgtctctttaaaaatatatatattttaaatatacttaaatatatatttctaatatctttaaatatatatatatattttaaagaccaatttatgggagaattgcacacagatgtgaaatgaatgtaatctaatagaagcctaatcagcccaccatgttctccactgaaaaatcctctttctttggggtttttctttctttcttttttgattttgcactggacggtgacgtcagccatgtacaggatccacaggggtggtgtcaaatgctattgaaattgtgttgaattgtatgctttttcacttttgataaataaacatgtaaaaatgtttcaaaaaaataataaaataaataaatacgaagaatatgtcaggacagtcaaaaaaaaaaaaaaaaaa

SEQ ID NO: 50 - protein, 387 aa, Homo sapiens
MQMSPALTCLVLGLALVFGEGSAVHHPPSYVAQASKDRNVVFSPYGVASVLAMLQLTTGGETQQQIQAAMGFKIDDKGMAPALRHLYKELMGPWNKDEISTTDAIFVQRDLKLVQGFMPHFFRLFRSTVKQVDFSEVERARFIINDWVKTHTKGMISNLLGKGAVDQLTRLVLVNALYFNGQWKTPFPDSSTHRRLFHKSDGSTVSVPMMAQTNKFNYTEFTTPDGHYYDILELPYHGDTLSMFIAAPYEKEVPLSALTNILSAQLISHWKGNMTRLPRLLVLPKFSLETEVDLRKPLENLGMTDMFRQFQADFTSLSDQEPLHVAQALQKVKIEVNESGTVASSSTAVIVSARMAPEEIIMDRPFLFVVRHNPTGTVLFMGQVMEP

SEQ ID NO: 51 - DNA, 9093 bp, Homo sapiens
cgagcccagtcgagccgcgctcacctcgggctcccgctccgtctccacctccgcctttgccctggcggcgcgaccccgtcccgggcgcggcccccagcagtcgcgcgccgttagcctcgcgcccgccgcgcagtccgggcccggcgcgatgggggccgccgccggccggagcccccacctggggcccgcgcccgcccgccgcccgcagcgctctctgctcctgctgcagctgctgctgctcgtcgctgccccggggtccacgcaggcccaggccgccccgttccccgagctgtgcagttatacatgggaagctgttgataccaaaaataatgtactttataaaatcaacatctgtggaagtgtggatattgtccagtgcgggccatcaagtgctgtttgtatgcacgacttgaagacacgcacttatcattcagtgggtgactctgttttgagaagtgcaaccagatctctcctggaattcaacacaacagtgagctgtgaccagcaaggcacaaatcacagagtccagagcagcattgccttcctgtgtgggaaaaccctgggaactcctgaatttgtaactgcaacagaatgtgtgcactactttgagtggaggaccactgcagcctgcaagaaagacatatttaaagcaaataaggaggtgccatgctatgtgtttgatgaagagttgaggaagcatgatctcaatcctctgatcaagcttagtggtgcctacttggtggatgactccgatccggacacttctctattcatcaatgtttgtagagacatagacacactacgagacccaggttcacagctgcgggcctgtccccccggcactgccgcctgcctggtaagaggacaccaggcgtttgatgttggccagccccgggacggactgaagctggtgcgcaaggacaggcttgtcctgagttacgtgagggaagaggcaggaaagctagacttttgtgatggtcacagccctgcggtgactattacatttgtttgcccgtcggagcggagagagggcaccattcccaaactcacagctaaatccaactgccgctatgaaattgagtggattactgagtatgcctgccacagagattacctggaaagtaaaacttgttctctgagcggcgagcagcaggatgtctccatagacctcacaccacttgcccagagcggaggttcatcctatatttcagatggaaaagaatatttgttttatttgaatgtctgtggagaaactgaaatacagttctgtaataaaaaacaagctgcagtttgccaagtgaaaaagagcgatacctctcaagtcaaagcagcaggaagataccacaatcagaccctccgatattcggatggagacctcaccttgatatattttggaggtgatgaatgcagctcagggtttcagcggatgagcgtcataaactttgagtgcaataaaaccgcaggtaacgatgggaaaggaactcctgtattcacaggggaggttgactgcacctacttcttcacatgggacacggaatacgcctgtgttaaggagaaggaagacctcctctgcggtgccaccgacgggaagaagcgctatgacctgtccgcgctggtccgccatgcagaaccagagcagaattgggaagctgtggatggcagtcagacggaaacagagaagaagcattttttcattaatatttgtcacagagtgctgcaggaaggcaaggcacgagggtgtcccgaggacgcggcagtgtgtgcagtggataaaaatggaagtaaaaatctgggaaaatttatttcctctcccatgaaagagaaaggaaacattcaactctcttattcagatggtgatgattgtggtcatggcaagaaaattaaaactaatatcacacttgtatgcaagccaggtgatctggaaagtgcaccagtgttgagaacttctggggaaggcggttgcttttatgagtttgagtggcacacagctgcggcctgtgtgctgtctaagacagaaggggagaactgcacggtctttgactcccaggcagggttttcttttgacttatcacctctcacaaagaaaaatggtgcctataaagttgagacaaagaagtatgacttttatataaatgtgtgtggcccggtgtctgtgagcccctgtcagccagactcaggagcctgccaggtggcaaaaagtgatgagaagacttggaacttgggtctgagtaatgcgaagctttcatattatgatgggatgatccaactgaactacagaggcggcacaccctataacaatgaaagacacacaccgagagctacgctcatcacctttctctgtgatcgagacgcgggagtgggcttccctgaatatcaggaagaggataactccacctacaacttccggtggtacaccagctatgcctgcccggaggagcccctggaatgcgtagtgaccgacccctccacgctggagcagtacgacctctccagtctggcaaaatctgaaggtggccttggaggaaactggtatgccatggacaactcaggggaacatgtcacgtggaggaaatactacattaacgtgtgtcggcctctgaatccagtgccgggctgcaaccgatatgcatcggcttgccagatgaagtatgaaaaagatcagggctccttcactgaagtggtttccatcagtaacttgggaatggcaaagaccggcccggtggttgaggacagcggcagcctccttctggaatacgtgaatgggtcggcctgcaccaccagcgatggcagacagaccacatataccacgaggatccatctcgtctgctccaggggcaggctgaacagccaccccatcttttctctcaactgggagtgtgtggtcagtttcctgtggaacacagaggctgcctgtcccattcagacaacgacggatacagaccaggcttgctctataagggatcccaacagtggatttgtgtttaatcttaatccgctaaacagttcgcaaggatataacgtctctggcattgggaagatttttatgtttaatgtctgcggcacaatgcctgtctgtgggaccatcctgggaaaacctgcttctggctgtgaggcagaaacccaaactgaagagctcaagaattggaagccagcaaggccagtcggaattgagaaaagcctccagctgtccacagagggcttcatcactctgacctacaaagggcctctctctgccaaaggtaccgctgatgcttttatcgtccgctttgtttgcaatgatgatgtttactcagggcccctcaaattcctgcatcaagatatcgactctgggcaagggatccgaaacacttactttgagtttgaaaccgcgttggcctgtgttccttctccagtggactgccaagtcaccgacctggctggaaatgagtacgacctgactggcctaagcacagtcaggaaaccttggacggctgttgacacctctgtcgatgggagaaagaggactttctatttgagcgtttgcaatcctctcccttacattcctggatgccagggcagcgcagtggggtcttgcttagtgtcagaaggcaatagctggaatctgggtgtggtgcagatgagtccccaagccgcggcgaatggatctttgagcatcatgtatgtcaacggtgacaagtgtgggaaccagcgcttctccaccaggatcacgtttgagtgtgctcagatatcgggctcaccagcatttcagcttcaggatggttgtgagtacgtgtttatctggagaactgtggaagcctgtcccgttgtcagagtggaaggggacaactgtgaggtgaaagacccaaggcatggcaacttgtatgacctgaagcccctgggcctcaacgacaccatcgtgagcgctggcgaatacacttattacttccgggtctgtgggaagctttcctcagacgtctgccccacaagtgacaagtccaaggtggtctcctcatgtcaggaaaagcgggaaccgcagggatttcacaaagtggcaggtctcctgactcagaagctaacttatgaaaatggcttgttaaaaatgaacttcacggggggggacacttgccataaggtttatcagcgctccacagccatcttcttctactgtgaccgcggcacccagcggccagtatttctaaaggagacttcagattgttcctacttgtttgagtggcgaacgcagtatgcctgcccacctttcgatctgactgaatgttcattcaaagatggggctggcaactccttcgacctctcgtccctgtcaaggtacagtgacaactgggaagccatcactgggacgggggacccggagcactacctcatcaatgtctgcaagtctctggccccgcaggctggcactgagccgtgccctccagaagcagccgcgtgtctgctgggtggctccaagcccgtgaacctcggcagggtaagggacggacctcagtggagagatggcataattgtcctgaaatacgttgatggcgacttatgtccagatgggattcggaaaaagtcaaccaccatccgattcacctgcagcgagagccaagtgaactccaggcccatgttcatcagcgccgtggaggactgtgagtacacctttgcctggcccacagccacagcctgtcccatgaagagcaacgagcatgatgactgccaggtcaccaacccaagcacaggacacctgtttgatctgagctccttaagtggcagggcgggattcacagctgcttacagcgagaaggggttggtttacatgagcatctgtggggagaatgaaaactgccctcctggcgtgggggcctgctttggacagaccaggattagcgtgggcaaggccaacaagaggctgagatacgtggaccaggtcctgcagctggtgtacaaggatgggtccccttgtccctccaaatccggcctgagctataagagtgtgatcagtttcgtgtgcaggcctgaggccgggccaaccaataggcccatgctcatctccctggacaagcagacatgcactctcttcttctcctggcacacgccgctggcctgcgagcaagcgaccgaatgttccgtgaggaatggaagctctattgttgacttgtctccccttattcatcgcactggtggttatgaggcttatgatgagagtgaggatgatgcctccgataccaaccctgatttctacatcaatatttgtcagccactaaatcccatgcacggagtgccctgtcctgccggagccgctgtgtgcaaagttcctattgatggtccccccatagatatcggccgggtagcaggaccaccaatactcaatccaatagcaaatgagatttacttgaattttgaaagcagtactccttgcttagcggacaagcatttcaactacacctcgctcatcgcgtttcactgtaagagaggtgtgagcatgggaacgcctaagctgttaaggaccagcgagtgcgactttgtgttcgaatgggagactcctgtcgtctgtcctgatgaagtgaggatggatggctgtaccctgacagatgagcagctcctctacagcttcaacttgtccagcctttccacgagcacctttaaggtgactcgcgactcgcgcacctacagcgttggggtgtgcacctttgcagtcgggccagaacaaggaggctgtaaggacggaggagtctgtctgctctcaggcaccaagggggcatcctttggacggctgcaatcaatgaaactggattacaggcaccaggatgaagcggtcgttttaagttacgtgaatggtgatcgttgccctccagaaaccgatgacggcgtcccctgtgtcttccccttcatattcaatgggaagagctacgaggagtgcatcatagagagcagggcgaagctgtggtgtagcacaactgcggactacgacagagaccacgagtggggcttctgcagacactcaaacagctaccggacatccagcatcatatttaagtgtgatgaagatgaggacattgggaggccacaagtcttcagtgaagtgcgtgggtgtgatgtgacatttgagtggaaaacaaaagttgtctgccctccaaagaagttggagtgcaaattcgtccagaaacacaaaacctacgacctgcggctgctctcctctctcaccgggtcctggtccctggtccacaacggagtctcgtactatataaatctgtgccagaaaatatataaagggcccctgggctgctctgaaagggccagcatttgcagaaggaccacaactggtgacgtccaggtcctgggactcgttcacacgcagaagctgggtgtcataggtgacaaagttgttgtcacgtactccaaaggttatccgtgtggtggaaataagaccgcatcctccgtgatagaattgacctgtacaaagacggtgggcagacctgcattcaagaggtttgatatcgacagctgcacttactacttcagctgggactcccgggctgcctgcgccgtgaagcctcaggaggtgcagatggtgaatgggaccatcaccaaccctataaatggcaagagcttcagcctcggagatatttattttaagctgttcagagcctctggggacatgaggaccaatggggacaactacctgtatgagatccaactttcctccatcacaagctccagaaacccggcgtgctctggagccaacatatgccaggtgaagcccaacgatcagcacttcagtcggaaagttggaacctctgacaagaccaagtactaccttcaagacggcgatctcgatgtcgtgtttgcctcttcctctaagtgcggaaaggataagaccaagtctgtttcttccaccatcttcttccactgtgaccctctggtggaggacgggatccccgagttcagtcacgagactgccgactgccagtacctcttctcttggtacacctcagccgtgtgtcctctgggggtgggctttgacagcgagaatcccggggacgacgggcagatgcacaaggggctgtcagaacggagccaggcagtcggcgcggtgctcagcctgctgctggtggcgctcacctgctgcctgctggccctgttgctctacaagaaggagaggagggaaacagtgataagtaagctgaccacttgctgtaggagaagttccaacgtgtcctacaaatactcaaaggtgaataaggaagaagagacagatgagaatgaaacagagtggctgatggaagagatccagctgcctcctccacggcagggaaaggaagggcaggagaacggccatattaccaccaagtcagtgaaagccctcagctccctgcatggggatgaccaggacagtgaggatgaggttctgaccatcccagaggtgaaagttcactcgggcaggggagctggggcagagagctcccacccagtgagaaacgcacagagcaatgcccttcaggagcgtgaggacgatagggtggggctggtcaggggtgagaaggcgaggaaagggaagtccagctctgcacagcagaagacagtgagctccaccaagctggtgtccttccatgacgacagcgacgaggacctcttacacatctgactccgcagtgcctgcaggggagcacggagccgcgggacagccaagcacctccaaccaaataagacttccactcgatgatgcttctataattttgcctttaacagaaactttcaaaagggaagagtttttgtgatgggggagagggtgaaggaggtcaggccccactccttcctgattgtttacagtcattggaataaggcatggctcagatcggccacagggcggtaccttgtgcccagggttttgccccaagtcctcatttaaaagcataaggccggacgcatctcaaaacagagggctgcattcgaagaaacccttgctgctttagtcccgatagggtatttgaccccgatatattttagcattttaattctctccccctatttattgactttgacaattactcaggtttgagaaaaaggaaaaaaaaacagccaccgtttcttcctgccagcaggggtgtgatgtaccagtttgtccatcttgagatggtgaggctgtcagtgtatggggcagcttccggcgggatgttgaactggtcattaatgtgtcccctgagttggagctcattctgtctcttttctcttttgctttctgtttcttaagggcacacacacgtgcgtgcgagcacacacacacatacgtgcacagggtccccgagtgcctaggttttggagagtttgcctgttctatgcctttagtcaggaatggctgcacctttttgcatgatatcttcaagcctgggcgtacagagcacatttgtcagtatttttgccggctggtgaattcaaacaacctgcccaaagattgatttgtgtgtttgtgtgtgtgtgtgtgtgtgtgtgtgtgtgtgtgagtggagttgaggtgtcagagaaaatgaattttttccagatttggggtataggtctcatctcttcaggttctcatgataccacctttactgtgcttatttttttaagaaaaaagtgttgatcaaccattcgacctataagaagccttaatttgcacagtgtgtgacttacagaaactgcatgaaaaatcatgggccagagcctcggccctagcattgcacttggcctcatgctggagggaggctgggcgggtacagcgcggaggaggagggaggccaggcgggcatggcgtggaggaggagggaggccgggcggtcacagcatggaggaggagggaggcgctgctggtgttcttattctggcggcagcgcctttcctgccatgtttagtgaatgacttttctcgcattgtagaattgtatatagactctggtgttctattgctgagaagcaaaccgccctgcagcatccctcagcctgtaccggtttggctggcttgtttgatttcaacatgagtgtattttttaaaattgatttttctcttcatttttttttcaatcaactttactgtaatataaagtattcaacaatttcaataaaagataaattattaaaa

SEQ ID NO: 52 - protein, 2491 aa, Homo sapiens
MGAAAGRSPHLGPAPARRPQRSLLLLQLLLLVAAPGSTQAQAAPFPELCSYTWEAVDTKNNVLYKINICGSVDIVQCGPSSAVCMHDLKTRTYHSVGDSVLRSATRSLLEFNTTVSCDQQGTNHRVQSSIAFLCGKTLGTPEFVTATECVHYFEWRTTAACKKDIFKANKEVPCYVFDEELRKHDLNPLIKLSGAYLVDDSDPDTSLFINVCRDIDTLRDPGSQLRACPPGTAACLVRGHQAFDVGQPRDGLKLVRKDRLVLSYVREEAGKLDFCDGHSPAVTITFVCPSERREGTIPKLTAKSNCRYEIEWITEYACHRDYLESKTCSLSGEQQDVSIDLTPLAQSGGSSYISDGKEYLFYLNVCGETEIQFCNKKQAAVCQVKKSDTSQVKAAGRYHNQTLRYSDGDLTLIYFGGDECSSGFQRMSVINFECNKTAGNDGKGTPVFTGEVDCTYFFTWDTEYACVKEKEDLLCGATDGKKRYDLSALVRHAEPEQNWEAVDGSQTETEKKHFFINICHRVLQEGKARGCPEDAAVCAVDKNGSKNLGKFISSPMKEKGNIQLSYSDGDDCGHGKKIKTNITLVCKPGDLESAPVLRTSGEGGCFYEFEWHTAAACVLSKTEGENCTVFDSQAGFSFDLSPLTKKNGAYKVETKKYDFYINVCGPVSVSPCQPDSGACQVAKSDEKTWNLGLSNAKLSYYDGMIQLNYRGGTPYNNERHTPRATLITFLCDRDAGVGFPEYQEEDNSTYNFRWYTSYACPEEPLECVVTDPSTLEQYDLSSLAKSEGGLGGNWYAMDNSGEHVTWRKYYINVCRPLNPVPGCNRYASACQMKYEKDQGSFTEVVSISNLGMAKTGPVVEDSGSLLLEYVNGSACTTSDGRQTTYTTRIHLVCSRGRLNSHPIFSLNWECVVSFLWNTEAACPIQTTTDTDQACSIRDPNSGFVFNLNPLNSSQGYNVSGIGKIFMFNVCGTMPVCGTILGKPASGCEAETQTEELKNWKPARPVGIEKSLQLSTEGFITLTYKGPLSAKGTADAFIVRFVCNDDVYSGPLKFLHQDIDSGQGIRNTYFEFETALACVPSPVDCQVTDLAGNEYDLTGLSTVRKPWTAVDTSVDGRKRTFYLSVCNPLPYIPGCQGSAVGSCLVSEGNSWNLGVVQMSPQAAANGSLSIMYVNGDKCGNQRFSTRITFECAQISGSPAFQLQDGCEYVFIWRTVEACPVVRVEGDNCEVKDPRHGNLYDLKPLGLNDTIVSAGEYTYYFRVCGKLSSDVCPTSDKSKVVSSCQEKREPQGFHKVAGLLTQKLTYENGLLKMNFTGGDTCHKVYQRSTAIFFYCDRGTQRPVFLKETSDCSYLFEWRTQYACPPFDLTECSFKDGAGNSFDLSSLSRYSDNWEAITGTGDPEHYLINVCKSLAPQAGTEPCPPEAAACLLGGSKPVNLGRVRDGPQWRDGIIVLKYVDGDLCPDGIRKKSTTIRFTCSESQVNSRPMFISAVEDCEYTFAWPTATACPMKSNEHDDCQVTNPSTGHLFDLSSLSGRAGFTAAYSEKGLVYMSICGENENCPPGVGACFGQTRISVGKANKRLRYVDQVLQLVYKDGSPCPSKSGLSYKSVISFVCRPEAGPTNRPMLISLDKQTCTLFFSWHTPLACEQATECSVRNGSSIVDLSPLIHRTGGYEAYDESEDDASDTNPDFYINICQPLNPMHGVPCPAGAAVCKVPIDGPPIDIGRVAGPPILNPIANEIYLNFESSTPCLADKHFNYTSLIAFHCKRGVSMGTPKLLRTSECDFVFEWETPVVCPDEVRMDGCTLTDEQLLYSFNLSSLSTSTFKVTRDSRTYSVGVCTFAVGPEQGGCKDGGVCLLSGTKGASFGRLQSMKLDYRHQDEAVVLSYVNGDRCPPETDDGVPCVFPFIFNGKSYEECIIESRAKLWCSTTADYDRDHEWGFCRHSNSYRTSSIIFKCDEDEDIGRPQVFSEVRGCDVTFEWKTKVVCPPKKLECKFVQKHKTYDLRLLSSLTGSWSLVHNGVSYYINLCQKIYKGPLGCSERASICRRTTTGDVQVLGLVHTQKLGVIGDKVVVTYSKGYPCGGNKTASSVIELTCTKTVGRPAFKRFDIDSCTYYFSWDSRAACAVKPQEVQMVNGTITNPINGKSFSLGDIYFKLFRASGDMRTNGDNYLYEIQLSSITSSRNPACSGANICQVKPNDQHFSRKVGTSDKTKYYLQDGDLDVVFASSSKCGKDKTKSVSSTIFFHCDPLVEDGIPEFSHETADCQYLFSWYTSAVCPLGVGFDSENPGDDGQMHKGLSERSQAVGAVLSLLLVALTCCLLALLLYKKERRETVISKLTTCCRRSSNVSYKYSKVNKEEETDENETEWLMEEIQLPPPRQGKEGQENGHITTKSVKALSSLHGDDQDSEDEVLTIPEVKVHSGRGAGAESSHPVRNAQSNALQEREDDRVGLVRGEKARKGKSSSAQQKTVSSTKLVSFHDDSDEDLLHI

SEQ ID NO: 53 - DNA, 1636 bp, Homo sapiens
gagaagccaatcagtgtcgtcgcggtcgctgttctaaagcccgcacgcacccaccgggactcagattctccccagacgccgaggatggccgtcatggcgccccgaaccctcctcctgctactctcgggggccctggccctgacccagacctgggcgggctcccactccatgaggtatttcttcacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccaggagacacggaatgtgaaggcccagtcacagactgaccgagtggacctggggaccctgcgcggctactacaaccagagcgaggccggttctcacaccatccagataatgtatggctgcgacgtggggtcggacgggcgcttcctccgcgggtaccggcaggacgcctacgacggcaaggattacatcgccctgaacgaggacctgcgctcttggaccgcggcggacatggcggctcagatcaccaagcgcaagtgggaggcggcccatgaggcggagcagttgagagcctacctggatggcacgtgcgtggagtggctccgcagatacctggagaacgggaaggagacgctgcagcgcacggacccccccaagacacatatgacccaccaccccatctctgaccatgaggccaccctgaggtgctgggccctgggcttctaccctgcggagatcacactgacctggcagcgggatggggaggaccagacccaggacacggagctcgtggagaccaggcctgcaggggatggaaccttccagaagtgggcggctgtggtggtgccttctggagaggagcagagatacacctgccatgtgcagcatgagggtctgcccaagcccctcaccctgagatgggagctgtcttcccagcccaccatccccatcgtgggcatcattgctggcctggttctccttggagctgtgatcactggagctgtggtcgctgccgtgatgtggaggaggaagagctcagatagaaaaggagggagttacactcaggctgcaagcagtgacagtgcccagggctctgatgtgtccctcacagcttgtaaagtgtgagacagctgccttgtgtgggactgagaggcaagagttgttcctgcccttccctttgtgacttgaagaaccctgactttgtttctgcaaaggcacctgcatgtgtctgtgttcgtgtaggcataatgtgaggaggtggggagaccaccccacccccatgtccaccatgaccctcttcccacgctgacctgtgctccctccccaatcatctttcctgttccagagaggtggggctgaggtgtctccatctctgtctcaacttcatggtgcactgagctgtaacttcttccttccctattaaaattagaaccttagtataaatttactttctcaaattcttgccatgagaggttgatgagttaattaaaggagaagattcctaaaatttgagagacaaaataaatggaagacatgagaaccttccagagtccaaaaaaaaaaaaaaaaaaaaaaaaaa

SEQ ID NO: 54 - protein, 365 aa, Homo sapiens
MAVMAPRTLLLLLSGALALTQTWAGSHSMRYFFTSVSRPGRGEPRFIAVGYVDDTQFVRFDSDAASQRMEPRAPWIEQEGPEYWDQETRNVKAQSQTDRVDLGTLRGYYNQSEAGSHTIQIMYGCDVGSDGRFLRGYRQDAYDGKDYIALNEDLRSWTAADMAAQITKRKWEAAHEAEQLRAYLDGTCVEWLRRYLENGKETLQRTDPPKTHMTHHPISDHEATLRCWALGFYPAEITLTWQRDGEDQTQDTELVETRPAGDGTFQKWAAVVVPSGEEQRYTCHVQHEGLPKPLTLRWELSSQPTIPIVGIIAGLVLLGAVITGAVVAAVMWRRKSSDRKGGSYTQAASSDSAQGSDVSLTACKV

SEQ ID NO: 55 - DNA, 1611 bp, Homo sapiens
gagaagccaatcagtgtcgtcgcggtcgctgttctaaagtccgcacgcacccaccgggactcagattctccccagacgccgaggatggccgtcatggcgccccgaaccctcctcctgctactctcgggggccctggccctgacccagacctgggcgggctcccactccatgaggtatttcttcacatccgtgtcccggcccggccgcggggagccccgcttcatcgccgtgggctacgtggacgacacgcagttcgtgcggttcgacagcgacgccgcgagccagaagatggagccgcgggcgccgtggatagagcaggaggggccggagtattgggaccaggagacacggaatatgaaggcccactcacagactgaccgagcgaacctggggaccctgcgcggctactacaaccagagcgaggacggttctcacaccatccagataatgtatggctgcgacgtggggccggacgggcgcttcctccgcgggtaccggcaggacgcctacgacggcaaggattacatcgccctgaacgaggacctgcgctcttggaccgcggcggacatggcagctcagatcaccaagcgcaagtgggaggcggtccatgcggcggagcagcggagagtctacctggagggccggtgcgtggacgggctccgcagatacctggagaacgggaaggagacgctgcagcgcacggacccccccaagacacatatgacccaccaccccatctctgaccatgaggccaccctgaggtgctgggccctgggcttctaccctgcggagatcacactgacctggcagcgggatggggaggaccagacccaggacacggagctcgtggagaccaggcctgcaggggatggaaccttccagaagtgggcggctgtggtggtgccttctggagaggagcagagatacacctgccatgtgcagcatgagggtctgcccaagcccctcaccctgagatgggagctgtcttcccagcccaccatccccatcgtgggcatcattgctggcctggttctccttggagctgtgatcactggagctgtggtcgctgccgtgatgtggaggaggaagagctcagatagaaaaggagggagttacactcaggctgcaagcagtgacagtgcccagggctctgatgtgtctctcacagcttgtaaagtgtgagacagctgccttgtgtgggactgagaggcaagagttgttcctgcccttccctttgtgacttgaagaaccctgactttgtttctgcaaaggcacctgcatgtgtctgtgttcgtgtaggcataatgtgaggaggtggggagagcaccccacccccatgtccaccatgaccctcttcccacgctgacctgtgctccctctccaatcatctttcctgttccagagaggtggggctgaggtgtctccatctctgtctcaacttcatggtgcactgagctgtaacttcttccttccctattaaaattagaacctgagtataaatttactttctcaaattcttgccatgagaggttgatgagttaattaaaggagaagattcctaaaatttgagagacaaaattaatggaacgcatgagaaccttccagagtcca

SEQ ID NO: 56 - protein, 365 aa, Homo sapiens
MAVMAPRTLLLLLSGALALTQTWAGSHSMRYFFTSVSRPGRGEPRFIAVGYVDDTQFVRFDSDAASQKMEPRAPWIEQEGPEYWDQETRNMKAHSQTDRANLGTLRGYYNQSEDGSHTIQIMYGCDVGPDGRFLRGYRQDAYDGKDYIALNEDLRSWTAADMAAQITKRKWEAVHAAEQRRVYLEGRCVDGLRRYLENGKETLQRTDPPKTHMTHHPISDHEATLRCWALGFYPAEITLTWQRDGEDQTQDTELVETRPAGDGTFQKWAAVVVPSGEEQRYTCHVQHEGLPKPLTLRWELSSQPTIPIVGIIAGLVLLGAVITGAVVAAVMWRRKSSDRKGGSYTQAASSDSAQGSDVSLTACKV

SEQ ID NO: 57 - DNA, 2588 bp, Homo sapiens
agcgttgtttttccttggcagctgcggagacccgtgataattcgttaactaattcaacaaacgggacccttctgtgtgccagaaaccgcaagcagttgctaacccagtgggacaggcggattggaagagcgggaaggtcctggcccagagcagtgtggtgagcgctgtgctggaagggaatgcgggcagtgggtacttggtagagcactgactgcctccggccagaggacttcccggaggaggtgacccatgagctggagtggtcagaggaaggctggcaaaagggcatcgtggacagaggaacagcctatgtgagtgggagcagagaccttggccaatgccattccttatggccttgtagtggaagcaaggtgatggggaaggaacactgtaggggatagctgtccacggacgctgtctacaagaccctggagtgagataacgtgcctggtactgtgccctgcatgtgtaagatgcccagttgaccttcgcagcaggagcctggatcagggcacttcctgcctcaggtattgctggacagcccagacacttccctctgtgaccatgaaactctgggtgtctgcattgctgatggcctggtttggtgtcctgagctgtgtgcaggccgaattcttcacctctattgggcacatgactgacctgatttatgcagagaaagagctggtgcagtctctgaaagagtacatccttgtggaggaagccaagctttccaagattaagagctgggccaacaaaatggaagccttgactagcaagtcagctgctgatgctgagggctacctggctcaccctgtgaatgcctacaaactggtgaagcggctaaacacagactggcctgcgctggaggaccttgtcctgcaggactcagctgcaggttttatcgccaacctctctgtgcagcggcagttcttccccactgatgaggacgagataggagctgccaaagccctgatgagacttcaggacacatacaggctggacccaggcacaatttccagaggggaacttccaggaaccaagtaccaggcaatgctgagtgtggatgactgctttgggatgggccgctcggcctacaatgaaggggactattatcatacggtgttgtggatggagcaggtgctaaagcagcttgatgccggggaggaggccaccacaaccaagtcacaggtgctggactacctcagctatgctgtcttccagttgggtgatctgcaccgtgccctggagctcacccgccgcctgctctcccttgacccaagccacgaacgagctggagggaatctgcggtactttgagcagttattggaggaagagagagaaaaaacgttaacaaatcagacagaagctgagctagcaaccccagaaggcatctatgagaggcctgtggactacctgcctgagagggatgtttacgagagcctctgtcgtggggagggtgtcaaactgacaccccgtagacagaagaggcttttctgtaggtaccaccatggcaacagggccccacagctgctcattgcccccttcaaagaggaggacgagtgggacagcccgcacatcgtcaggtactacgatgtcatgtctgatgaggaaatcgagaggatcaaggagatcgcaaaacctaaacttgcacgagccaccgttcgtgatcccaagacaggagtcctcactgtcgccagctaccgggtttccaaaagctcctggctagaggaagatgatgaccctgttgtggcccgagtaaatcgtcggatgcagcatatcacagggttaacagtaaagactgcagaattgttacaggttgcaaattatggagtgggaggacagtatgaaccgcacttcgacttctctaggaatgatgagcgagatactttcaagcatttagggacggggaatcgtgtggctactttcttaaactacatgagtgatgtagaagctggtggtgccaccgtcttccctgatctgggggctgcaatttggcctaagaagggtacagctgtgttctggtacaacctcttgcggagcggggaaggtgactaccgaacaagacatgctgcctgccctgtgcttgtgggctgcaagtgggtctccaataagtggttccatgaacgaggacaggagttcttgagaccttgtggatcaacagaagttgactgacatccttttctgtccttccccttcctggtccttcagcccatgtcaacgtgacagacacctttgtatgttcctttgtatgttcctatcaggctgatttttggagaaatgaatgtttgtctggagcagagggagaccatactagggcgactcctgtgtgactgaagtcccagcccttccattcagcctgtgccatccctggccccaaggctaggatcaaagtggctgcagcagagttagctgtctagcgcctagcaaggtgcctttgtacctcaggtgttttaggtgtgagatgtttcagtgaaccaaagttctgataccttgtttacatgtttgtttttatggcatttctatctattgtggctttaccaaaaaataaaatgtccctaccagaagccttaaaaaaaaaaaaaaaaaaa

SEQ ID NO: 58 - protein, 535 aa, Homo sapiens
MKLWVSALLMAWFGVLSCVQAEFFTSIGHMTDLIYAEKELVQSLKEYILVEEAKLSKIKSWANKMEALTSKSAADAEGYLAHPVNAYKLVKRLNTDWPALEDLVLQDSAAGFIANLSVQRQFFPTDEDEIGAAKALMRLQDTYRLDPGTISRGELPGTKYQAMLSVDDCFGMGRSAYNEGDYYHTVLWMEQVLKQLDAGEEATTTKSQVLDYLSYAVFQLGDLHRALELTRRLLSLDPSHERAGGNLRYFEQLLEEEREKTLTNQTEAELATPEGIYERPVDYLPERDVYESLCRGEGVKLTPRRQKRLFCRYHHGNRAPQLLIAPFKEEDEWDSPHIVRYYDVMSDEEIERIKEIAKPKLARATVRDPKTGVLTVASYRVSKSSWLEEDDDPVVARVNRRMQHITGLTVKTAELLQVANYGVGGQYEPHFDFSRNDERDTFKHLGTGNRVATFLNYMSDVEAGGATVFPDLGAAIWPKKGTAVFWYNLLRSGEGDYRTRHAACPVLVGCKWVSNKWFHERGQEFLRPCGSTEVD

SEQ ID NO: 59 - DNA, 2582 bp, Homo sapiens
agcgttgtttttccttggcagctgcggagacccgtgataattcgttaactaattcaacaaacgggacccttctgtgtgccagaaaccgcaagcagttgctaacccagtgggacaggcggattggaagagcgggaaggtcctggcccagagcagtgtggtgagcgctgtgctggaagggaatgcgggcagtgggtacttggtagagcactgactgcctccggccagaggacttcccggaggaggtgacccatgagctggagtggtcagaggaaggctggcaaaagggcatcgtggacagaggaacagcctatgtgagtgggagcagagaccttggccaatgccattccttatggccttgtagtggaagcaaggtgatggggaaggaacactgtaggggatagctgtccacggacgctgtctacaagaccctggagtgagataacgtgcctggtactgtgccctgcatgtgtaagatgcccagttgaccttcgcagcaggagcctggatcagggcacttcctgcctcaggtattgctggacagcccagacacttccctctgtgaccatgaaactctgggtgtctgcattgctgatggcctggtttggtgtcctgagctgtgtgcaggccgaattcttcacctctattgggcacatgactgacctgatttatgcagagaaagagctggtgcagtctctgaaagagtacatccttgtggaggaagccaagctttccaagattaagagctgggccaacaaaatggaagccttgactagcaagtcagctgctgatgctgagggctacctggctcaccctgtgaatgcctacaaactggtgaagcggctaaacacagactggcctgcgctggaggaccttgtcctgcaggactcagctgcaggttttatcgccaacctctctgtgcagcggcagttcttccccactgatgaggacgagataggagctgccaaagccctgatgagacttcaggacacatacaggctggacccaggcacaatttccagaggggaacttccaggaaccaagtaccaggcaatgctgagtgtggatgactgctttgggatgggccgctcggcctacaatgaaggggactattatcatacggtgttgtggatggagcaggtgctaaagcagcttgatgccggggaggaggccaccacaaccaagtcacaggtgctggactacctcagctatgctgtcttccagttgggtgatctgcaccgtgccctggagctcacccgccgcctgctctcccttgacccaagccacgaacgagctggagggaatctgcggtactttgagcagttattggaggaagagagagaaaaaacgttaacaaatcagacagaagctgagctagcaaccccagaaggcatctatgagaggcctgtggactacctgcctgagagggatgtttacgagagcctctgtcgtggggagggtgtcaaactgacaccccgtagacagaagaggcttttctgtaggtaccaccatggcaacagggccccacagctgctcattgcccccttcaaagaggaggacgagtgggacagcccgcacatcgtcaggtactacgatgtcatgtctgatgaggaaatcgagaggatcaaggagatcgcaaaacctaaacttgcacgagccaccgttcgtgatcccaagacaggagtcctcactgtcgccagctaccgggtttccaaaagctcctggctagaggaagatgatgaccctgttgtggcccgagtaaatcgtcggatgcagcatatcacagggttaacagtaaagactgcagaattgttacaggttgcaaattatggagtgggaggacagtatgaaccgcacttcgacttctctaggcgaccttttgacagcggcctcaaaacagaggggaataggttagcgacgtttcttaactacatgagtgatgtagaagctggtggtgccaccgtcttccctgatctgggggctgcaatttggcctaagaagggtacagctgtgttctggtacaacctcttgcggagcggggaaggtgactaccgaacaagacatgctgcctgccctgtgcttgtgggctgcaagtgggtctccaataagtggttccatgaacgaggacaggagttcttgagaccttgtggatcaacagaagttgactgacatccttttctgtccttccccttcctggtccttcagcccatgtcaacgtgacagacacctttgtatgttcctttgtatgttcctatcaggctgatttttggagaaatgaatgtttgtctggagcagagggagaccatactagggcgactcctgtgtgactgaagtcccagcccttccattcagcctgtgccatccctggccccaaggctaggatcaaagtggctgcagcagagttagctgtctagcgcctagcaaggtgcctttgtacctcaggtgttttaggtgtgagatgtttcagtgaaccaaagttctgataccttgtttacatgtttgtttttatggcatttctatctattgtggctttaccaaaaaataaaatgtccctaccagaagccttaaaaaaaaaaaaaaaaaaa

SEQ ID NO: 60 - protein, 533 aa, Homo sapiens
MKLWVSALLMAWFGVLSCVQAEFFTSIGHMTDLIYAEKELVQSLKEYILVEEAKLSKIKSWANKMEALTSKSAADAEGYLAHPVNAYKLVKRLNTDWPALEDLVLQDSAAGFIANLSVQRQFFPTDEDEIGAAKALMRLQDTYRLDPGTISRGELPGTKYQAMLSVDDCFGMGRSAYNEGDYYHTVLWMEQVLKQLDAGEEATTTKSQVLDYLSYAVFQLGDLHRALELTRRLLSLDPSHERAGGNLRYFEQLLEEEREKTLTNQTEAELATPEGIYERPVDYLPERDVYESLCRGEGVKLTPRRQKRLFCRYHHGNRAPQLLIAPFKEEDEWDSPHIVRYYDVMSDEEIERIKEIAKPKLARATVRDPKTGVLTVASYRVSKSSWLEEDDDPVVARVNRRMQHITGLTVKTAELLQVANYGVGGQYEPHFDFSRRPFDSGLKTEGNRLATFLNYMSDVEAGGATVFPDLGAAIWPKKGTAVFWYNLLRSGEGDYRTRHAACPVLVGCKWVSNKWFHERGQEFLRPCGSTEVD

SEQ ID NO: 61 - DNA, 2110 bp, Homo sapiens
aagggaggaggcgccgagctgaccgggcgacgccgcgggaggttctggaaacgccgggagctgcgagtgtccagacacttccctctgtgaccatgaaactctgggtgtctgcattgctgatggcctggtttggtgtcctgagctgtgtgcaggccgaattcttcacctctattgggcacatgactgacctgatttatgcagagaaagagctggtgcagtctctgaaagagtacatccttgtggaggaagccaagctttccaagattaagagctgggccaacaaaatggaagccttgactagcaagtcagctgctgatgctgagggctacctggctcaccctgtgaatgcctacaaactggtgaagcggctaaacacagactggcctgcgctggaggaccttgtcctgcaggactcagctgcaggttttatcgccaacctctctgtgcagcggcagttcttccccactgatgaggacgagataggagctgccaaagccctgatgagacttcaggacacatacaggctggacccaggcacaatttccagaggggaacttccaggaaccaagtaccaggcaatgctgagtgtggatgactgctttgggatgggccgctcggcctacaatgaaggggactattatcatacggtgttgtggatggagcaggtgctaaagcagcttgatgccggggaggaggccaccacaaccaagtcacaggtgctggactacctcagctatgctgtcttccagttgggtgatctgcaccgtgccctggagctcacccgccgcctgctctcccttgacccaagccacgaacgagctggagggaatctgcggtactttgagcagttattggaggaagagagagaaaaaacgttaacaaatcagacagaagctgagctagcaaccccagaaggcatctatgagaggcctgtggactacctgcctgagagggatgtttacgagagcctctgtcgtggggagggtgtcaaactgacaccccgtagacagaagaggcttttctgtaggtaccaccatggcaacagggccccacagctgctcattgcccccttcaaagaggaggacgagtgggacagcccgcacatcgtcaggtactacgatgtcatgtctgatgaggaaatcgagaggatcaaggagatcgcaaaacctaaacttgcacgagccaccgttcgtgatcccaagacaggagtcctcactgtcgccagctaccgggtttccaaaagctcctggctagaggaagatgatgaccctgttgtggcccgagtaaatcgtcggatgcagcatatcacagggttaacagtaaagactgcagaattgttacaggttgcaaattatggagtgggaggacagtatgaaccgcacttcgacttctctaggcgaccttttgacagcggcctcaaaacagaggggaataggttagcgacgtttcttaactacatgagtgatgtagaagctggtggtgccaccgtcttccctgatctgggggctgcaatttggcctaagaagggtacagctgtgttctggtacaacctcttgcggagcggggaaggtgactaccgaacaagacatgctgcctgccctgtgcttgtgggctgcaagtgggtctccaataagtggttccatgaacgaggacaggagttcttgagaccttgtggatcaacagaagttgactgacatccttttctgtccttccccttcctggtccttcagcccatgtcaacgtgacagacacctttgtatgttcctttgtatgttcctatcaggctgatttttggagaaatgaatgtttgtctggagcagagggagaccatactagggcgactcctgtgtgactgaagtcccagcccttccattcagcctgtgccatccctggccccaaggctaggatcaaagtggctgcagcagagttagctgtctagcgcctagcaaggtgcctttgtacctcaggtgttttaggtgtgagatgtttcagtgaaccaaagttctgataccttgtttacatgtttgtttttatggcatttctatctattgtggctttaccaaaaaataaaatgtccctaccagaagccttaaaaaaaaaaaaaaaaaaa

SEQ ID NO: 62 - protein, 533 aa, Homo sapiens; identical to SEQ ID NO: 60

SEQ ID NO: 63 - DNA, 2246 bp, Homo sapiens
aagggaggaggcgccgagctgaccgggcgacgccgcgggaggttctggaaacgccgggagctgcgagtgtccagctgcggagacccgtgataattcgttaactaattcaacaaacgggacccttctgtgtgccagaaaccgcaagcagttgctaacccagtgggacaggcggattggaagagcgggaaggtcctggcccagagcagtgtgacacttccctctgtgaccatgaaactctgggtgtctgcattgctgatggcctggtttggtgtcctgagctgtgtgcaggccgaattcttcacctctattgggcacatgactgacctgatttatgcagagaaagagctggtgcagtctctgaaagagtacatccttgtggaggaagccaagctttccaagattaagagctgggccaacaaaatggaagccttgactagcaagtcagctgctgatgctgagggctacctggctcaccctgtgaatgcctacaaactggtgaagcggctaaacacagactggcctgcgctggaggaccttgtcctgcaggactcagctgcaggttttatcgccaacctctctgtgcagcggcagttcttccccactgatgaggacgagataggagctgccaaagccctgatgagacttcaggacacatacaggctggacccaggcacaatttccagaggggaacttccaggaaccaagtaccaggcaatgctgagtgtggatgactgctttgggatgggccgctcggcctacaatgaaggggactattatcatacggtgttgtggatggagcaggtgctaaagcagcttgatgccggggaggaggccaccacaaccaagtcacaggtgctggactacctcagctatgctgtcttccagttgggtgatctgcaccgtgccctggagctcacccgccgcctgctctcccttgacccaagccacgaacgagctggagggaatctgcggtactttgagcagttattggaggaagagagagaaaaaacgttaacaaatcagacagaagctgagctagcaaccccagaaggcatctatgagaggcctgtggactacctgcctgagagggatgtttacgagagcctctgtcgtggggagggtgtcaaactgacaccccgtagacagaagaggcttttctgtaggtaccaccatggcaacagggccccacagctgctcattgcccccttcaaagaggaggacgagtgggacagcccgcacatcgtcaggtactacgatgtcatgtctgatgaggaaatcgagaggatcaaggagatcgcaaaacctaaacttgcacgagccaccgttcgtgatcccaagacaggagtcctcactgtcgccagctaccgggtttccaaaagctcctggctagaggaagatgatgaccctgttgtggcccgagtaaatcgtcggatgcagcatatcacagggttaacagtaaagactgcagaattgttacaggttgcaaattatggagtgggaggacagtatgaaccgcacttcgacttctctaggcgaccttttgacagcggcctcaaaacagaggggaataggttagcgacgtttcttaactacatgagtgatgtagaagctggtggtgccaccgtcttccctgatctgggggctgcaatttggcctaagaagggtacagctgtgttctggtacaacctcttgcggagcggggaaggtgactaccgaacaagacatgctgcctgccctgtgcttgtgggctgcaagtgggtctccaataagtggttccatgaacgaggacaggagttcttgagaccttgtggatcaacagaagttgactgacatccttttctgtccttccccttcctggtccttcagcccatgtcaacgtgacagacacctttgtatgttcctttgtatgttcctatcaggctgatttttggagaaatgaatgtttgtctggagcagagggagaccatactagggcgactcctgtgtgactgaagtcccagcccttccattcagcctgtgccatccctggccccaaggctaggatcaaagtggctgcagcagagttagctgtctagcgcctagcaaggtgcctttgtacctcaggtgttttaggtgtgagatgtttcagtgaaccaaagttctgataccttgtttacatgtttgtttttatggcatttctatctattgtggctttaccaaaaaataaaatgtccctaccagaagccttaaaaaaaaaaaaaaaaaaa

SEQ ID NO: 64 - protein, 533 aa, Homo sapiens; identical to SEQ ID NO: 60

SEQ ID NO: 65 - DNA, 2252 bp, Homo sapiens
aagggaggaggcgccgagctgaccgggcgacgccgcgggaggttctggaaacgccgggagctgcgagtgtccagctgcggagacccgtgataattcgttaactaattcaacaaacgggacccttctgtgtgccagaaaccgcaagcagttgctaacccagtgggacaggcggattggaagagcgggaaggtcctggcccagagcagtgtgacacttccctctgtgaccatgaaactctgggtgtctgcattgctgatggcctggtttggtgtcctgagctgtgtgcaggccgaattcttcacctctattgggcacatgactgacctgatttatgcagagaaagagctggtgcagtctctgaaagagtacatccttgtggaggaagccaagctttccaagattaagagctgggccaacaaaatggaagccttgactagcaagtcagctgctgatgctgagggctacctggctcaccctgtgaatgcctacaaactggtgaagcggctaaacacagactggcctgcgctggaggaccttgtcctgcaggactcagctgcaggttttatcgccaacctctctgtgcagcggcagttcttccccactgatgaggacgagataggagctgccaaagccctgatgagacttcaggacacatacaggctggacccaggcacaatttccagaggggaacttccaggaaccaagtaccaggcaatgctgagtgtggatgactgctttgggatgggccgctcggcctacaatgaaggggactattatcatacggtgttgtggatggagcaggtgctaaagcagcttgatgccggggaggaggccaccacaaccaagtcacaggtgctggactacctcagctatgctgtcttccagttgggtgatctgcaccgtgccctggagctcacccgccgcctgctctcccttgacccaagccacgaacgagctggagggaatctgcggtactttgagcagttattggaggaagagagagaaaaaacgttaacaaatcagacagaagctgagctagcaaccccagaaggcatctatgagaggcctgtggactacctgcctgagagggatgtttacgagagcctctgtcgtggggagggtgtcaaactgacaccccgtagacagaagaggcttttctgtaggtaccaccatggcaacagggccccacagctgctcattgcccccttcaaagaggaggacgagtgggacagcccgcacatcgtcaggtactacgatgtcatgtctgatgaggaaatcgagaggatcaaggagatcgcaaaacctaaacttgcacgagccaccgttcgtgatcccaagacaggagtcctcactgtcgccagctaccgggtttccaaaagctcctggctagaggaagatgatgaccctgttgtggcccgagtaaatcgtcggatgcagcatatcacagggttaacagtaaagactgcagaattgttacaggttgcaaattatggagtgggaggacagtatgaaccgcacttcgacttctctaggaatgatgagcgagatactttcaagcatttagggacggggaatcgtgtggctactttcttaaactacatgagtgatgtagaagctggtggtgccaccgtcttccctgatctgggggctgcaatttggcctaagaagggtacagctgtgttctggtacaacctcttgcggagcggggaaggtgactaccgaacaagacatgctgcctgccctgtgcttgtgggctgcaagtgggtctccaataagtggttccatgaacgaggacaggagttcttgagaccttgtggatcaacagaagttgactgacatccttttctgtccttccccttcctggtccttcagcccatgtcaacgtgacagacacctttgtatgttcctttgtatgttcctatcaggctgatttttggagaaatgaatgtttgtctggagcagagggagaccatactagggcgactcctgtgtgactgaagtcccagcccttccattcagcctgtgccatccctggccccaaggctaggatcaaagtggctgcagcagagttagctgtctagcgcctagcaaggtgcctttgtacctcaggtgttttaggtgtgagatgtttcagtgaaccaaagttctgataccttgtttacatgtttgtttttatggcatttctatctattgtggctttaccaaaaaataaaatgtccctaccagaagccttaaaaaaaaaaaaaaaaaaa

SEQ ID NO: 66 - protein, 535 aa, Homo sapiens; identical to SEQ ID NO: 58

SEQ ID NO: 67 - DNA, 2097 bp, Homo sapiens
ggtccttcagcctcgttcccgggcagtataaagtttgctgtctcctttgttcgccctcgttgcgcagtagtgctagcggcttcgcggttcggtcctcgcacccggcagccgccactggtgctgagctgctaggaagcccctatcgccgagctcgttggagcttgaacccattgtcacccctccgactcaccggcccaaaaaaaaaaaaacatggttgaagcagatcgcccaggaaagctcttcattggtgggcttaatacggaaacaaatgagaaagctcttgaagcagtatttggcaaatatggacgaatagtggaagtactcttgatgaaagaccgtgaaaccaacaaatcaagaggatttgcttttgtcacctttgaaagcccagcagacgctaaggatgcagccagagacatgaatggaaagtcattagatggaaaagccatcaaggtggaacaagccaccaaaccatcatttgaaagtggtagacgtggaccgcctccacctccaagaagtagaggccctccaagaggtcttagaggtggaagaggaggaagtggaggaaccaggggacctccctcacggggaggacacatggatgacggtggatattccatgaattttaacatgagttcttccaggggaccactcccagtaaaaagaggaccaccaccaagaagtgggggtcctcctcctaagagatctgcaccttcaggaccagttcgcagtagcagtggaatgggaggaagagctcctgtatcacgtggaagagatagttatggaggtccacctcgaagggaaccgctgccctctcgtagagatgtttatttgtccccaagagatgatgggtattctactaaagacagctattcaagcagagattacccaagttctcgtgatactagagattatgcaccaccaccacgagattatacttaccgtgattatggtcattccagttcacgtgatgactatccatcaagaggatatagcgatagagatggatatggtcgtgatcgtgactattcagatcatccaagtggaggttcctacagagattcatatgagagttatggtaactcacgtagtgctccacctacacgagggcccccgccatcttatggtggaagcagtcgctatgatgattacagcagctcacgtgacggatatggtggaagtcgagacagttactcaagcagccgaagtgatctctactcaagtggtcgtgatcgggttggcagacaagaaagagggcttcccccttctatggaaagggggtaccctcctccacgtgattcctacagcagttcaagccgcggagcaccaagaggtggtggccgtggaggaagccgatctgatagagggggaggcagaagcagatactagaaacaaacaaaactttggaccaaaatcccagttcaaagaaacaaaaagtggaaactattctatcataactacccaaggactactaaaaggaaaaattgtgttactttttttaaattccctgttaagttcccctccataatttttatgttcttgtgaggaaaaaagtaaaacatgtttaattttatttgactttcgcattgcttttcaacaagcaaatgttaaatgtgttaagacttgtactagtgttgtaactttccaagtaaaagtatcccctaaaggccacttcctatctgatttttcccagcaaatgaggcaggcaattctaagatcttccacaaaacatctagccatctaaaatggagagatgaatcattctacctatacaaacaagctagctattagagggtggttggggtatgctactcataagatttcagggtgtcttccaactgaaatctcaatgttctcagtacgaaaaacctgaaatcacatgcctatgtaaggaaagtgctattcacccagtaaacccaaaaaagcaaatggataatgctggccattttgcctttctgacatttccttgggaatctgcaagaacctcccctttcccttcccccaataagaccatttaagtgtgtgttaaacaactacagaatactaaataaaaagtttggccaaaaccaaccatgaagctgcaaaaaaaaaaaaaaaaaa

SEQ ID NO: 68 - protein, 391 aa, Homo sapiens
MVEADRPGKLFIGGLNTETNEKALEAVFGKYGRIVEVLLMKDRETNKSRGFAFVTFESPADAKDAARDMNGKSLDGKAIKVEQATKPSFESGRRGPPPPPRSRGPPRGLRGGRGGSGGTRGPPSRGGHMDDGGYSMNFNMSSSRGPLPVKRGPPPRSGGPPPKRSAPSGPVRSSSGMGGRAPVSRGRDSYGGPPRREPLPSRRDVYLSPRDDGYSTKDSYSSRDYPSSRDTRDYAPPPRDYTYRDYGHSSSRDDYPSRGYSDRDGYGRDRDYSDHPSGGSYRDSYESYGNSRSAPPTRGPPPSYGGSSRYDDYSSSRDGYGGSRDSYSSSRSDLYSSGRDRVGRQERGLPPSMERGYPPPRDSYSSSSRGAPRGGGRGGSRSDRGGGRSRY

SEQ ID NO: 69 - DNA, 2071 bp, Homo sapiens
ggtccttcagcctcgttcccgggcagtataaagtttgctgtctcctttgttcgccctcgttgcgcagtagtgctagcggcttcgcggttcggtcctcgcacccggcagccgccactggtgctgagctgctaggaagcccctatcgccgagctcgttggagcttgaacccattgtcacccctccgactcaccggcccaaaaaaaaaaaaacatggttgaagcagatcgcccaggaaagctcttcattggtgggcttaatacggaaacaaatgagaaagctcttgaagcagtatttggcaaatatggacgaatagtggaagtactcttgatgaaagaccgtgaaaccaacaaatcaagaggatttgcttttgtcacctttgaaagcccagcagacgctaaggatgcagccagagacatgaatggaaagctcctgtatcacgtggaagagatagttatggaggtccacctcgaagggaaccgctgccctctcgtagagatgtttatttgtccccaagagatgatgggtattctactaaagacagctattcaagcagagattacccaagttctcgtgatactagagattatgcaccaccaccacgagattatacttaccgtgattatggtcattccagttcacgtgatgactatccatcaagaggatatagcgatagagatggatatggtcgtgatcgtgactattcagatcatccaagtggaggttcctacagagattcatatgagagttatggttggtgattttgctcattatggtcgtggagtgctgattgattcacagtagataaagctggcagtaagaaatgctaagagttgttgaagcagaaggcggctgattgtcaataagtcactacagttgcataagcagtgctgtcagaattggtttggtgcaggcaatagattttgccttcaggggttcctgtggatctgaggaaggcatcagtgttgattaacactcataactagggagtgactggtagttacttaaagcaagtaattgaccaaatggaaaaggggaagtaattaaggaaattggtaagtggaggtagtcaggaagttcttgtggttcttcacatagattttacagctttggctttcattttgtttagctaaagtcatggggacaactcttcaatttagaacttaagttgaattataaaaatgatggatataagtggtagctgtatctagtgaagtgtctgtcagtaagtgaaacattttttggtggtggcttatccacaaacagtttagttgtagaataaaacttatgagtgacatctggaaagtaaccatgctaagatggcaagcacactggaaacaattaggccacttggctttcttttgctgtattgttttataagcctactttacctcccagtcttggaaacaagttttagttttttattggtttggagactagagccaatagtataatgttctcaaaggaaacagacttgagttgttggattagaggaactaacccaacttatatgattttttttttgtttttgtcgtgtagttatggcactgtcttatttggaacatttgcaactagggataatacaacatttttaactctcatttgacaacctactactaatcacagaccacaagggtaatgaccaaatttatgtggtttttgcactccatagttgtcttagcccaatctttctatactcttacgattacttgggttaacgcttctgtgaggaccttctggctcttgagataccctaaatatttaagatatttagatatcttgaagatagtataggatatagagattgtaccaaataggaatataaggagtatgttaaaatgaccagatacctgtttgatagtttactgacctagcagatgtgtggaaaaggaatcagatcttgattcttctgggtttatactggttgtaaaacagaatgatacagaaaatgttttccttgtttaactggtagttgaacatagaacttgggtattatagatcacttttcactttttggaatgttttgtattgaaacttaataaaactttaacatggaaaaaaaaaaaaaaaaaaa

SEQ ID NO: 70 - protein, 196 aa, Homo sapiens
MVEADRPGKLFIGGLNTETNEKALEAVFGKYGRIVEVLLMKDRETNKSRGFAFVTFESPADAKDAARDMNGKLLYHVEEIVMEVHLEGNRCPLVEMFICPQEMMGILLKTAIQAEITQVLVILEIMHHHHEIILTVIMVIPVHVMTIHQEDIAIEMDMVVIVTIQIIQVEVPTEIHMRVMVGDFAHYGRGVLIDSQ

SEQ ID NO: 71 - DNA, 1137 bp, Homo sapiens
actcgcgcccttgccgctgccaccgcaccccgccatggagcggccgtcgctgcgcgccctgctcctcggcgccgctgggctgctgctcctgctcctgcccctctcctcttcctcctcttcggacacctgcggcccctgcgagccggcctcctgcccgcccctgcccccgctgggctgcctgctgggcgagacccgcgacgcgtgcggctgctgccctatgtgcgcccgcggcgagggcgagccgtgcgggggtggcggcgccggcagggggtactgcgcgccgggcatggagtgcgtgaagagccgcaagaggcggaagggtaaagccggggcagcagccggcggtccgggtgtaagcggcgtgtgcgtgtgcaagagccgctacccggtgtgcggcagcgacggcaccacctacccgagcggctgccagctgcgcgccgccagccagagggccgagagccgcggggagaaggccatcacccaggtcagcaagggcacctgcgagcaaggtccttccatagtgacgccccccaaggacatctggaatgtcactggtgcccaggtgtacttgagctgtgaggtcatcggaatcccgacacctgtcctcatctggaacaaggtaaaaaggggtcactatggagttcaaaggacagaactcctgcctggtgaccgggacaacctggccattcagacccggggtggcccagaaaagcatgaagtaactggctgggtgctggtatctcctctaagtaaggaagatgctggagaatatgagtgccatgcatccaattcccaaggacaggcttcagcatcagcaaaaattacagtggttgatgccttacatgaaataccagtgaaaaaaggtgaaggtgccgagctataaacctccagaatattattagtctgcatggttaaaagtagtcatggataactacattacctgttcttgcctaataagtttcttttaatccaatccactaacactttagttatattcactggttttacacagagaaatacaaaataaagatcacacatcaagactatctacaaaaatttattatatatttacagaagaaaagcatgcatatcattaaacaaataaaatactttttatcacaacacagtaaaaaaaaa

SEQ ID NO: 72 - protein, 282 aa, Homo sapiens
MERPSLRALLLGAAGLLLLLLPLSSSSSSDTCGPCEPASCPPLPPLGCLLGETRDACGCCPMCARGEGEPCGGGGAGRGYCAPGMECVKSRKRRKGKAGAAAGGPGVSGVCVCKSRYPVCGSDGTTYPSGCQLRAASQRAESRGEKAITQVSKGTCEQGPSIVTPPKDIWNVTGAQVYLSCEVIGIPTPVLIWNKVKRGHYGVQRTELLPGDRDNLAIQTRGGPEKHEVTGWVLVSPLSKEDAGEYECHASNSQGQASASAKITVVDALHEIPVKKGEGAEL

SEQ ID NO: 73 - DNA, 1051 bp, Homo sapiens
actcgcgcccttgccgctgccaccgcaccccgccatggagcggccgtcgctgcgcgccctgctcctcggcgccgctgggctgctgctcctgctcctgcccctctcctcttcctcctcttcggacacctgcggcccctgcgagccggcctcctgcccgcccctgcccccgctgggctgcctgctgggcgagacccgcgacgcgtgcggctgctgccctatgtgcgcccgcggcgagggcgagccgtgcgggggtggcggcgccggcagggggtactgcgcgccgggcatggagtgcgtgaagagccgcaagaggcggaagggtaaagccggggcagcagccggcggtccgggtgtaagcggcgtgtgcgtgtgcaagagccgctacccggtgtgcggcagcgacggcaccacctacccgagcggctgccagctgcgcgccgccagccagagggccgagagccgcggggagaaggccatcacccaggtcagcaagggcacctgcgagcaaggtccttccatagtgacgccccccaaggacatctggaatgtcactggtgcccaggtgtacttgagctgtgaggtcatcggaatcccgacacctgtcctcatctggaacaaggtaaaaaggggtcactatggagttcaaaggacagaactcctgcctggtgaccgggacaacctggccattcagacccggggtggcccagaaaagcatgaagtaactggctgggtgctggtatctcctctaagtaaggaagatgctggagaatatgagtgccatgcatccaattcccaaggacaggcttcagcatcagcaaaaattacagtggttgatgccttacatgaaataccagtgaaaaaaggtacacaataaatctcacagccatttaaaaatgactagtacatttgctttaaaaagaacagaactaagtatgaaagtatcagacgtagctattgatgaaattctgtagttagcaacccataagggcattaagtatgccattaaaatgtacagcatgagactccaaaagattatctggatgggtgactg

SEQ ID NO: 74 - protein, 279 aa, Homo sapiens
MERPSLRALLLGAAGLLLLLLPLSSSSSSDTCGPCEPASCPPLPPLGCLLGETRDACGCCPMCARGEGEPCGGGGAGRGYCAPGMECVKSRKRRKGKAGAAAGGPGVSGVCVCKSRYPVCGSDGTTYPSGCQLRAASQRAESRGEKAITQVSKGTCEQGPSIVTPPKDIWNVTGAQVYLSCEVIGIPTPVLIWNKVKRGHYGVQRTELLPGDRDNLAIQTRGGPEKHEVTGWVLVSPLSKEDAGEYECHASNSQGQASASAKITVVDALHEIPVKKGTQ

SEQ ID NO: 75 - DNA, 1586 bp, Homo sapiens
tccgcagtcccggttctaaagtccccagtcacccacccggactcacattctccccagaggccgagatgcgggtcatggcgccccgagccctcctcctgctgctctcgggaggcctggccctgaccgagacctgggcctgctcccactccatgaggtatttcgacaccgccgtgtcccggcccggccgcggagagccccgcttcatctcagtgggctacgtggacgacacgcagttcgtgcggttcgacagcgacgccgcgagtccgagaggggagccgcgggcgccgtgggtggagcaggaggggccggagtattgggaccgggagacacagaagtacaagcgccaggcacaggctgaccgagtgagcctgcggaacctgcgcggctactacaaccagagcgaggacgggtctcacaccctccagaggatgtctggctgcgacctggggcccgacgggcgcctcctccgcgggtatgaccagtccgcctacgacggcaaggattacatcgccctgaacgaggacctgcgctcctggaccgccgcggacaccgcggctcagatcacccagcgcaagttggaggcggcccgtgcggcggagcagctgagagcctacctggagggcacgtgcgtggagtggctccgcagatacctggagaacgggaaggagacgctgcagcgcgcagaacccccaaagacacacgtgacccaccaccccctctctgaccatgaggccaccctgaggtgctgggccctgggcttctaccctgcggagatcacactgacctggcagcgggatggggaggaccagacccaggacaccgagcttgtggagaccaggccagcaggagatggaaccttccagaagtgggcagctgtggtggtgccttctggacaagagcagagatacacgtgccatatgcagcacgaggggctgcaagagcccctcaccctgagctgggagccatcttcccagcccaccatccccatcatgggcatcgttgctggcctggctgtcctggttgtcctagctgtccttggagctgtggtcaccgctatgatgtgtaggaggaagagctcaggtggaaaaggagggagctgctctcaggctgcgtgcagcaacagtgcccagggctctgatgagtctctcatcacttgtaaagcctgagacagctgcctgtgtgggactgagatgcaggatttcttcacacctctcctttgtgacttcaagagcctctggcatctctttctgcaaaggcacctgaatgtgtctgcgttcctgttagcataatgtgaggaggtggagagacagcccacccccgtgtccaccgtgacccctgtccccacactgacctgtgttccctccccgatcatctttcctgttccagagaggtggggctggatgtctccatctctgtctcaaattcatggtgcactgagctgcaacttcttacttccctaatgaagttaagaacctgaatataaatttgtgttctcaaatatttgctatgaagcgttgatggattaattaaataagtcaattcctagaagttgagagagcaaataaagacctgagaaccttccagaa

SEQ ID NO: 76 - protein, 366 aa, Homo sapiens
MRVMAPRALLLLLSGGLALTETWACSHSMRYFDTAVSRPGRGEPRFISVGYVDDTQFVRFDSDAASPRGEPRAPWVEQEGPEYWDRETQKYKRQAQADRVSLRNLRGYYNQSEDGSHTLQRMSGCDLGPDGRLLRGYDQSAYDGKDYIALNEDLRSWTAADTAAQITQRKLEAARAAEQLRAYLEGTCVEWLRRYLENGKETLQRAEPPKTHVTHHPLSDHEATLRCWALGFYPAEITLTWQRDGEDQTQDTELVETRPAGDGTFQKWAAVVVPSGQEQRYTCHMQHEGLQEPLTLSWEPSSQPTIPIMGIVAGLAVLVVLAVLGAVVTAMMCRRKSSGGKGGSCSQAACSNSAQGSDESLITCKA

SEQ ID NO: 77 - DNA, 1586 bp, Homo sapiens
tccgcagtcccggttctaaagtccccagtcacccacccggactcacattctccccagaggccgagatgcgggtcatggcgccccgagccctcctcctgctgctctcgggaggcctggccctgaccgagacctgggcctgctcccactccatgaggtatttcgacaccgccgtgtcccggcccggccgcggagagccccgcttcatctcagtgggctacgtggacgacacgcagttcgtgcggttcgacagcgacgccgcgagtccgagaggggagccgcgggcgccgtgggtggagcaggaggggccggagtattgggaccgggagacacagaactacaagcgccaggcacaggctgaccgagtgagcctgcggaacctgcgcggctactacaaccagagcgaggacgggtctcacaccctccagaggatgtatggctgcgacctggggcccgacgggcgcctcctccgcgggtatgaccagtccgcctacgacggcaaggattacatcgccctgaacgaggacctgcgctcctggaccgccgcggacaccgcggctcagatcacccagcgcaagttggaggcggcccgtgcggcggagcagctgagagcctacctggagggcacgtgcgtggagtggctccgcagatacctggagaacgggaaggagacgctgcagcgcgcagaacccccaaagacacacgtgacccaccaccccctctctgaccatgaggccaccctgaggtgctgggccctgggcttctaccctgcggagatcacactgacctggcagcgggatggggaggaccagacccaggacaccgagcttgtggagaccaggccagcaggagatggaaccttccagaagtgggcagctgtggtggtgccttctggacaagagcagagatacacgtgccatatgcagcacgaggggctgcaagagcccctcaccctgagctgggagccatcttcccagcccaccatccccatcatgggcatcgttgctggcctggctgtcctggttgtcctagctgtccttggagctgtggtcaccgctatgatgtgtaggaggaagagctcaggtggaaaaggagggagctgctctcaggctgcgtgcagcaacagtgcccagggctctgatgagtctctcatcacttgtaaagcctgagacagctgcctgtgtgggactgagatgcaggatttcttcacacctctcctttgtgacttcaagagcctctggcatctctttctgcaaaggcgtctgaatgtgtctgcgttcctgttagcataatgtgaggaggtggagagacagcccacccccgtgtccaccgtgacccctgtccccacactgacctgtgttccctccccgatcatctttcctgttccagagaggtggggctggatgtctccatctctgtctcaaattcatggtgcactgagctgcaacttcttacttccctaatgaagttaagaacctgaatataaatttgtgttctcaaatatttgctatgaagcgttgatggattaattaaataagtcaattcctagaagttgagagagcaaataaagacctgagaaccttccagaa

SEQ ID NO: 78 - protein, 366 aa, Homo sapiens
MRVMAPRALLLLLSGGLALTETWACSHSMRYFDTAVSRPGRGEPRFISVGYVDDTQFVRFDSDAASPRGEPRAPWVEQEGPEYWDRETQNYKRQAQADRVSLRNLRGYYNQSEDGSHTLQRMYGCDLGPDGRLLRGYDQSAYDGKDYIALNEDLRSWTAADTAAQITQRKLEAARAAEQLRAYLEGTCVEWLRRYLENGKETLQRAEPPKTHVTHHPLSDHEATLRCWALGFYPAEITLTWQRDGEDQTQDTELVETRPAGDGTFQKWAAVVVPSGQEQRYTCHMQHEGLQEPLTLSWEPSSQPTIPIMGIVAGLAVLVVLAVLGAVVTAMMCRRKSSGGKGGSCSQAACSNSAQGSDESLITCKA

SEQ ID NO: 79 - DNA, 2360 bp, Homo sapiens
cagacggccatttgtggcggcgctggaggctgcgttcggcaggcgctgcggagacgcgtagaggagcgcgccccccggccgctgccgcccctggcccgtgccgtcaccccgcttctccgcgcctcgggcggtacccagccagtccccagcgccgcgctaccgcgctgaccggccctccagacgcctcccggtacccgggaccccagcccggccgctcgcccgcagcccgccggccgcacacgtccccggagccgggcctagggcgggcggcagcggcggctcggcgcagtcaggctgggctctgtagcgtccccatggccgcggccggctggcgggacggctccggccaggagaagtaccggctcgtggtggtcggcgggggcggcgtgggcaagtcggcgctcaccatccagttcatccagtcctattttgtaacggattatgatccaaccattgaagattcttacacaaagcagtgtgtgatagatgacagagcagcccggctagatattttggatacagcaggacaagaagagtttggagccatgagagaacagtatatgaggactggcgaaggcttcctgttggtcttttcagtcacagatagaggcagttttgaagaaatctataagtttcaaagacagattctcagagtaaaggatcgtgatgagttcccaatgattttaattggtaataaagcagatctggatcatcaaagacaggtaacacaggaagaaggacaacagttagcacggcagcttaaggtaacatacatggaggcatcagcaaagattaggatgaatgtagatcaagctttccatgaacttgtccgggttatcaggaaatttcaagagcaggaatgtcctccttcaccagaaccaacacggaaagaaaaagacaagaaaggctgccattgtgtcattttctagaatcccttcagttttagctaccaacggccaggaaaagccctcatcttctctttctctcctcagtttacatcttgttggtacctttctagccttagacaaatgatcaccatgttagccttagacgaagaagctggctagtcctttctgtgaagctaatacaatggtcatttccagacaaatttaaaggaaacactaaggctgcttcaaagattatctgattcctttaaaatatatgtctatatacacagacatgctctttttttaagtgcttacattttaatagagatgaatcagttttggaatctaagctgtttgccaagctgaagctacaggttgtgaaataatttttaacttttggaatcatactgcctactgttactctaaatagaaatatagggttttttttaatgtgaatttttgcctatctttaaacatttcaatgtcagcctttgttaaccttaaatacactgaattgaatctacaaaagtgaaccatctcagacctttactgatactacaacttttgttttctgatggccaaaataccaaatgcctgttgtatttatggattaaaaactgcttataaaaccctgtgttactactcctactcttggagatgataatattctatgtggtcaaatatttggactcatttaggacttagatatttcagtgtacttgattttttaatttaactctttttcacagccacgctaagggtaaaaaggaataatttccttctgtcttccttttcaagtatttctgggtaagggattcaaaaaactaaaactgtttttgtttgtaatataaaatatggaattgatctttccagggtcagagatgattaatgtttttgctatatacttttatacattattttcttatcaaactagttaacaagtatttttatatgtttgtaagcagatatgctttcatagcataccttgtgtatatgtaaagataagtatttaattctcactgttcacttttaactgacaaagaaaaacaagtggaaactacagaaactgtggtagaacttttacttgctggtctggtcttggttgtacccatctttggccagtcacataactactcaagaaaccttcccaatagagtacaacaggatgagactctgaaatcactttcagtattccctgctagatattgattgttatttcaagtattaagtgtaagcttttaatggataattagtataactgtggatggcatctgattttgtttttaattctgtggattgtgtttaagcaattcaatagtatgttcctgattttgagatgctaagtggtattgcacagttgtcactttatcaagtgtgtacaacagtcccatgaagtttatagagcatacccttgtatagcttcaggtgctagaattaaaattgatctgttatcacaagaaaaaaaaaaaaaaa

SEQ ID NO: 80 - protein, 204 aa, Homo sapiens
MAAAGWRDGSGQEKYRLVVVGGGGVGKSALTIQFIQSYFVTDYDPTIEDSYTKQCVIDDRAARLDILDTAGQEEFGAMREQYMRTGEGFLLVFSVTDRGSFEEIYKFQRQILRVKDRDEFPMILIGNKADLDHQRQVTQEEGQQLARQLKVTYMEASAKIRMNVDQAFHELVRVIRKFQEQECPPSPEPTRKEKDKKGCHCVIF

SEQ ID NO: 81 - DNA, 2209 bp, Homo sapiens
gggagggcggagctggaagggtgggaagcaccgatccaccttattgctctggccgaggccagagacctccgggagaggctgggccaccgagccgggctttactgctccgagggtccgggcgtggggctggagctggagccccgcgcgctgcttttccagccgcctgcggccgcgccttcaccgtcggggcgatagcggtggcaacttggccgcggctccgcgtggtctccgggcttccccgcgccgcctgagccggagctgcccgcttcaatcctattttgtaacggattatgatccaaccattgaagattcttacacaaagcagtgtgtgatagatgacagagcagcccggctagatattttggatacagcaggacaagaagagtttggagccatgagagaacagtatatgaggactggcgaaggcttcctgttggtcttttcagtcacagatagaggcagttttgaagaaatctataagtttcaaagacagattctcagagtaaaggatcgtgatgagttcccaatgattttaattggtaataaagcagatctggatcatcaaagacaggtaacacaggaagaaggacaacagttagcacggcagcttaaggtaacatacatggaggcatcagcaaagattaggatgaatgtagatcaagctttccatgaacttgtccgggttatcaggaaatttcaagagcaggaatgtcctccttcaccagaaccaacacggaaagaaaaagacaagaaaggctgccattgtgtcattttctagaatcccttcagttttagctaccaacggccaggaaaagccctcatcttctctttctctcctcagtttacatcttgttggtacctttctagccttagacaaatgatcaccatgttagccttagacgaagaagctggctagtcctttctgtgaagctaatacaatggtcatttccagacaaatttaaaggaaacactaaggctgcttcaaagattatctgattcctttaaaatatatgtctatatacacagacatgctctttttttaagtgcttacattttaatagagatgaatcagttttggaatctaagctgtttgccaagctgaagctacaggttgtgaaataatttttaacttttggaatcatactgcctactgttactctaaatagaaatatagggttttttttaatgtgaatttttgcctatctttaaacatttcaatgtcagcctttgttaaccttaaatacactgaattgaatctacaaaagtgaaccatctcagacctttactgatactacaacttttgttttctgatggccaaaataccaaatgcctgttgtatttatggattaaaaactgcttataaaaccctgtgttactactcctactcttggagatgataatattctatgtggtcaaatatttggactcatttaggacttagatatttcagtgtacttgattttttaatttaactctttttcacagccacgctaagggtaaaaaggaataatttccttctgtcttccttttcaagtatttctgggtaagggattcaaaaaactaaaactgtttttgtttgtaatataaaatatggaattgatctttccagggtcagagatgattaatgtttttgctatatacttttatacattattttcttatcaaactagttaacaagtatttttatatgtttgtaagcagatatgctttcatagcataccttgtgtatatgtaaagataagtatttaattctcactgttcacttttaactgacaaagaaaaacaagtggaaactacagaaactgtggtagaacttttacttgctggtctggtcttggttgtacccatctttggccagtcacataactactcaagaaaccttcccaatagagtacaacaggatgagactctgaaatcactttcagtattccctgctagatattgattgttatttcaagtattaagtgtaagcttttaatggataattagtataactgtggatggcatctgattttgtttttaattctgtggattgtgtttaagcaattcaatagtatgttcctgattttgagatgctaagtggtattgcacagttgtcactttatcaagtgtgtacaacagtcccatgaagtttatagagcatacccttgtatagcttcaggtgctagaattaaaattgatctgttatcacaagaaaaaaaaaaaaaaa

SEQ ID NO: 82 - protein, 127 aa, Homo sapiens
MREQYMRTGEGFLLVFSVTDRGSFEEIYKFQRQILRVKDRDEFPMILIGNKADLDHQRQVTQEEGQQLARQLKVTYMEASAKIRMNVDQAFHELVRVIRKFQEQECPPSPEPTRKEKDKKGCHCVIF

SEQ ID NO: 83 - DNA, 2054 bp, Homo sapiens
atctcagatgcatgcagctcctgctgggcggtttcattctctgccagccattcattcacattaaaagcaatggcccattaaggaaataagtggatgatgctcctccatcacccatgtcctattttgtaacggattatgatccaaccattgaagattcttacacaaagcagtgtgtgatagatgacagagcagcccggctagatattttggatacagcaggacaagaagagtttggagccatgagagaacagtatatgaggactggcgaaggcttcctgttggtcttttcagtcacagatagaggcagttttgaagaaatctataagtttcaaagacagattctcagagtaaaggatcgtgatgagttcccaatgattttaattggtaataaagcagatctggatcatcaaagacaggtaacacaggaagaaggacaacagttagcacggcagcttaaggtaacatacatggaggcatcagcaaagattaggatgaatgtagatcaagctttccatgaacttgtccgggttatcaggaaatttcaagagcaggaatgtcctccttcaccagaaccaacacggaaagaaaaagacaagaaaggctgccattgtgtcattttctagaatcccttcagttttagctaccaacggccaggaaaagccctcatcttctctttctctcctcagtttacatcttgttggtacctttctagccttagacaaatgatcaccatgttagccttagacgaagaagctggctagtcctttctgtgaagctaatacaatggtcatttccagacaaatttaaaggaaacactaaggctgcttcaaagattatctgattcctttaaaatatatgtctatatacacagacatgctctttttttaagtgcttacattttaatagagatgaatcagttttggaatctaagctgtttgccaagctgaagctacaggttgtgaaataatttttaacttttggaatcatactgcctactgttactctaaatagaaatatagggttttttttaatgtgaatttttgcctatctttaaacatttcaatgtcagcctttgttaaccttaaatacactgaattgaatctacaaaagtgaaccatctcagacctttactgatactacaacttttgttttctgatggccaaaataccaaatgcctgttgtatttatggattaaaaactgcttataaaaccctgtgttactactcctactcttggagatgataatattctatgtggtcaaatatttggactcatttaggacttagatatttcagtgtacttgattttttaatttaactctttttcacagccacgctaagggtaaaaaggaataatttccttctgtcttccttttcaagtatttctgggtaagggattcaaaaaactaaaactgtttttgtttgtaatataaaatatggaattgatctttccagggtcagagatgattaatgtttttgctatatacttttatacattattttcttatcaaactagttaacaagtatttttatatgtttgtaagcagatatgctttcatagcataccttgtgtatatgtaaagataagtatttaattctcactgttcacttttaactgacaaagaaaaacaagtggaaactacagaaactgtggtagaacttttacttgctggtctggtcttggttgtacccatctttggccagtcacataactactcaagaaaccttcccaatagagtacaacaggatgagactctgaaatcactttcagtattccctgctagatattgattgttatttcaagtattaagtgtaagcttttaatggataattagtataactgtggatggcatctgattttgtttttaattctgtggattgtgtttaagcaattcaatagtatgttcctgattttgagatgctaagtggtattgcacagttgtcactttatcaagtgtgtacaacagtcccatgaagtttatagagcatacccttgtatagcttcaggtgctagaattaaaattgatctgttatcacaagaaaaaaaaaaaaaaa

SEQ ID NO: 84 - protein, 169 aa, Homo sapiens
MSYFVTDYDPTIEDSYTKQCVIDDRAARLDILDTAGQEEFGAMREQYMRTGEGFLLVFSVTDRGSFEEIYKFQRQILRVKDRDEFPMILIGNKADLDHQRQVTQEEGQQLARQLKVTYMEASAKIRMNVDQAFHELVRVIRKFQEQECPPSPEPTRKEKDKKGCHCVIF

SEQ ID NO: 85 - DNA, 2186 bp, Homo sapiens
attgctctggccgaggccagagacctccgggagaggctgggccaccgagccgggctttactgctccgagggtccgggcgtggggctggagctggagccccgcgcgctgcttttccagccgcctgcggccgcgccttcaccgtcggggcgatagcggtggcaacttggccgcggctccgcgtggtctccgggcttccccgcgccgcctgagccggagctgcccgcttcaagtactgtgtatttctttgttcctattttgtaacggattatgatccaaccattgaagattcttacacaaagcagtgtgtgatagatgacagagcagcccggctagatattttggatacagcaggacaagaagagtttggagccatgagagaacagtatatgaggactggcgaaggcttcctgttggtcttttcagtcacagatagaggcagttttgaagaaatctataagtttcaaagacagattctcagagtaaaggatcgtgatgagttcccaatgattttaattggtaataaagcagatctggatcatcaaagacaggtaacacaggaagaaggacaacagttagcacggcagcttaaggtaacatacatggaggcatcagcaaagattaggatgaatgtagatcaagctttccatgaacttgtccgggttatcaggaaatttcaagagcaggaatgtcctccttcaccagaaccaacacggaaagaaaaagacaagaaaggctgccattgtgtcattttctagaatcccttcagttttagctaccaacggccaggaaaagccctcatcttctctttctctcctcagtttacatcttgttggtacctttctagccttagacaaatgatcaccatgttagccttagacgaagaagctggctagtcctttctgtgaagctaatacaatggtcatttccagacaaatttaaaggaaacactaaggctgcttcaaagattatctgattcctttaaaatatatgtctatatacacagacatgctctttttttaagtgcttacattttaatagagatgaatcagttttggaatctaagctgtttgccaagctgaagctacaggttgtgaaataatttttaacttttggaatcatactgcctactgttactctaaatagaaatatagggttttttttaatgtgaatttttgcctatctttaaacatttcaatgtcagcctttgttaaccttaaatacactgaattgaatctacaaaagtgaaccatctcagacctttactgatactacaacttttgttttctgatggccaaaataccaaatgcctgttgtatttatggattaaaaactgcttataaaaccctgtgttactactcctactcttggagatgataatattctatgtggtcaaatatttggactcatttaggacttagatatttcagtgtacttgattttttaatttaactctttttcacagccacgctaagggtaaaaaggaataatttccttctgtcttccttttcaagtatttctgggtaagggattcaaaaaactaaaactgtttttgtttgtaatataaaatatggaattgatctttccagggtcagagatgattaatgtttttgctatatacttttatacattattttcttatcaaactagttaacaagtatttttatatgtttgtaagcagatatgctttcatagcataccttgtgtatatgtaaagataagtatttaattctcactgttcacttttaactgacaaagaaaaacaagtggaaactacagaaactgtggtagaacttttacttgctggtctggtcttggttgtacccatctttggccagtcacataactactcaagaaaccttcccaatagagtacaacaggatgagactctgaaatcactttcagtattccctgctagatattgattgttatttcaagtattaagtgtaagcttttaatggataattagtataactgtggatggcatctgattttgtttttaattctgtggattgtgtttaagcaattcaatagtatgttcctgattttgagatgctaagtggtattgcacagttgtcactttatcaagtgtgtacaacagtcccatgaagtttatagagcatacccttgtatagcttcaggtgctagaattaaaattgatctgttatcacaagaaaaaaaaaaaaaaa

SEQ ID NO: 86 - protein, 127 aa, Homo sapiens; identical to SEQ ID NO: 82

SEQ ID NO: 87 - DNA, 5820 bp, Homo sapiens
agccgctgcgcccgagctggcctgcgagttcagggctcctgtcgctctccaggagcaacctctactccggacgcacaggcattccccgcgcccctccagccctcgccgccctcgccaccgctcccggccgccgcgctccggtacacacaggatccctgctgggcaccaacagctccaccatggggctggcctggggactaggcgtcctgttcctgatgcatgtgtgtggcaccaaccgcattccagagtctggcggagacaacagcgtgtttgacatctttgaactcaccggggccgcccgcaaggggtctgggcgccgactggtgaagggccccgacccttccagcccagctttccgcatcgaggatgccaacctgatcccccctgtgcctgatgacaagttccaagacctggtggatgctgtgcgggcagaaaagggtttcctccttctggcatccctgaggcagatgaagaagacccggggcacgctgctggccctggagcggaaagaccactctggccaggtcttcagcgtggtgtccaatggcaaggcgggcaccctggacctcagcctgaccgtccaaggaaagcagcacgtggtgtctgtggaagaagctctcctggcaaccggccagtggaagagcatcaccctgtttgtgcaggaagacagggcccagctgtacatcgactgtgaaaagatggagaatgctgagttggacgtccccatccaaagcgtcttcaccagagacctggccagcatcgccagactccgcatcgcaaaggggggcgtcaatgacaatttccagggggtgctgcagaatgtgaggtttgtctttggaaccacaccagaagacatcctcaggaacaaaggctgctccagctctaccagtgtcctcctcacccttgacaacaacgtggtgaatggttccagccctgccatccgcactaactacattggccacaagacaaaggacttgcaagccatctgcggcatctcctgtgatgagctgtccagcatggtcctggaactcaggggcctgcgcaccattgtgaccacgctgcaggacagcatccgcaaagtgactgaagagaacaaagagttggccaatgagctgaggcggcctcccctatgctatcacaacggagttcagtacagaaataacgaggaatggactgttgatagctgcactgagtgtcactgtcagaactcagttaccatctgcaaaaaggtgtcctgccccatcatgccctgctccaatgccacagttcctgatggagaatgctgtcctcgctgttggcccagcgactctgcggacgatggctggtctccatggtccgagtggacctcctgttctacgagctgtggcaatggaattcagcagcgcggccgctcctgcgatagcctcaacaaccgatgtgagggctcctcggtccagacacggacctgccacattcaggagtgtgacaagagatttaaacaggatggtggctggagccactggtccccgtggtcatcttgttctgtgacatgtggtgatggtgtgatcacaaggatccggctctgcaactctcccagcccccagatgaacgggaaaccctgtgaaggcgaagcgcgggagaccaaagcctgcaagaaagacgcctgccccatcaatggaggctggggtccttggtcaccatgggacatctgttctgtcacctgtggaggaggggtacagaaacgtagtcgtctctgcaacaaccccacaccccagtttggaggcaaggactgcgttggtgatgtaacagaaaaccagatctgcaacaagcaggactgtccaattgatggatgcctgtccaatccctgctttgccggcgtgaagtgtactagctaccctgatggcagctggaaatgtggtgcttgtccccctggttacagtggaaatggcatccagtgcacagatgttgatgagtgcaaagaagtgcctgatgcctgcttcaaccacaatggagagcaccggtgtgagaacacggaccccggctacaactgcctgccctgccccccacgcttcaccggctcacagcccttcggccagggtgtcgaacatgccacggccaacaaacaggtgtgcaagccccgtaacccctgcacggatgggacccacgactgcaacaagaacgccaagtgcaactacctgggccactatagcgaccccatgtaccgctgcgagtgcaagcctggctacgctggcaatggcatcatctgcggggaggacacagacctggatggctggcccaatgagaacctggtgtgcgtggccaatgcgacttaccactgcaaaaaggataattgccccaaccttcccaactcagggcaggaagactatgacaaggatggaattggtgatgcctgtgatgatgacgatgacaatgataaaattccagatgacagggacaactgtccattccattacaacccagctcagtatgactatgacagagatgatgtgggagaccgctgtgacaactgtccctacaaccacaacccagatcaggcagacacagacaacaatggggaaggagacgcctgtgctgcagacattgatggagacggtatcctcaatgaacgggacaactgccagtacgtctacaatgtggaccagagagacactgatatggatggggttggagatcagtgtgacaattgccccttggaacacaatccggatcagctggactctgactcagaccgcattggagatacctgtgacaacaatcaggatattgatgaagatggccaccagaacaatctggacaactgtccctatgtgcccaatgccaaccaggctgaccatgacaaagatggcaagggagatgcctgtgaccacgatgatgacaacgatggcattcctgatgacaaggacaactgcagactcgtgcccaatcccgaccagaaggactctgacggcgatggtcgaggtgatgcctgcaaagatgattttgaccatgacagtgtgccagacatcgatgacatctgtcctgagaatgttgacatcagtgagaccgatttccgccgattccagatgattcctctggaccccaaagggacatcccaaaatgaccctaactgggttgtacgccatcagggtaaagaactcgtccagactgtcaactgtgatcctggactcgctgtaggttatgatgagtttaatgctgtggacttcagtggcaccttcttcatcaacaccgaaagggacgatgactatgctggatttgtctttggctaccagtccagcagccgcttttatgttgtgatgtggaagcaagtcacccagtcctactgggacaccaaccccacgagggctcagggatactcgggcctttctgtgaaagttgtaaactccaccacagggcctggcgagcacctgcggaacgccctgtggcacacaggaaacacccctggccaggtgcgcaccctgtggcatgaccctcgtcacataggctggaaagatttcaccgcctacagatggcgtctcagccacaggccaaagacgggtttcattagagtggtgatgtatgaagggaagaaaatcatggctgactcaggacccatctatgataaaacctatgctggtggtagactagggttgtttgtcttctctcaagaaatggtgttcttctctgacctgaaatacgaatgtagagatccctaatcatcaaattgttgattgaaagactgatcataaaccaatgctggtattgcaccttctggaactatgggcttgagaaaacccccaggatcacttctccttggcttccttcttttctgtgcttgcatcagtgtggactcctagaacgtgcgacctgcctcaagaaaatgcagttttcaaaaacagactcagcattcagcctccaatgaataagacatcttccaagcatataaacaattgctttggtttccttttgaaaaagcatctacttgcttcagttgggaaggtgcccattccactctgcctttgtcacagagcagggtgctattgtgaggccatctctgagcagtggactcaaaagcattttcaggcatgtcagagaagggaggactcactagaattagcaaacaaaaccaccctgacatcctccttcaggaacacggggagcagaggccaaagcactaaggggagggcgcatacccgagacgattgtatgaagaaaatatggaggaactgttacatgttcggtactaagtcattttcaggggattgaaagactattgctggatttcatgatgctgactggcgttagctgattaacccatgtaaataggcacttaaatagaagcaggaaagggagacaaagactggcttctggacttcctccctgatccccacccttactcatcacctgcagtggccagaattagggaatcagaatcaaaccagtgtaaggcagtgctggctgccattgcctggtcacattgaaattggtggcttcattctagatgtagcttgtgcagatgtagcaggaaaataggaaaacctaccatctcagtgagcaccagctgcctcccaaaggaggggcagccgtgcttatatttttatggttacaatggcacaaaattattatcaacctaactaaaacattccttttctcttttttcctgaattatcatggagttttctaattctctcttttggaatgtagattttttttaaatgctttacgatgtaaaatatttattttttacttattctggaagatctggctgaaggattattcatggaacaggaagaagcgtaaagactatccatgtcatctttgttgagagtcttcgtgactgtaagattgtaaatacagattatttattaactctgttctgcctggaaatttaggcttcatacggaaagtgtttgagagcaagtagttgacatttatcagcaaatctcttgcaagaacagcacaaggaaaatcagtctaataagctgctctgccccttgtgctcagagtggatgttatgggattctttttttctctgttttatcttttcaagtggaattagttggttatccatttgcaaatgttttaaattgcaaagaaagccatgaggtcttcaatactgttttaccccatcccttgtgcatatttccagggagaaggaaagcatatacacttttttctttcatttttccaaaagagaaaaaaatgacaaaaggtgaaacttacatacaaatattacctcatttgttgtgtgactgagtaaagaatttttggatcaagcggaaagagtttaagtgtctaacaaacttaaagctactgtagtacctaaaaagtcagtgttgtacatagcataaaaactctgcagagaagtattcccaataaggaaatagcattgaaatgttaaatacaatttctgaaagttatgttttttttctatcatctggtataccattgctttatttttataaattattttctcattgccattggaatagatatctcagattgtgtagatatgctatttaaataatttatcaggaaatactgcctgtagagttagtatttctatttttatataatgtttgcacactgaattgaagaattgttggttttttcttttttttgttttgtttttttttttttttttttttgcttttgacctcccatttttactatttgccaatacctttttctaggaatgtgcttttttttgtacacatttttatccattttacattctaaagcagtgtaagttgtatattactgtttcttatgtacaaggaacaacaataaatcatatggaaatttatatttataaaaaaaaaaaaaaaaaaaaaaaaaaaaaaa

SEQ ID NO: 88 - protein, 1170 aa, Homo sapiens
MGLAWGLGVLFLMHVCGTNRIPESGGDNSVFDIFELTGAARKGSGRRLVKGPDPSSPAFRIEDANLIPPVPDDKFQDLVDAVRAEKGFLLLASLRQMKKTRGTLLALERKDHSGQVFSVVSNGKAGTLDLSLTVQGKQHVVSVEEALLATGQWKSITLFVQEDRAQLYIDCEKMENAELDVPIQSVFTRDLASIARLRIAKGGVNDNFQGVLQNVRFVFGTTPEDILRNKGCSSSTSVLLTLDNNVVNGSSPAIRTNYIGHKTKDLQAICGISCDELSSMVLELRGLRTIVTTLQDSIRKVTEENKELANELRRPPLCYHNGVQYRNNEEWTVDSCTECHCQNSVTICKKVSCPIMPCSNATVPDGECCPRCWPSDSADDGWSPWSEWTSCSTSCGNGIQQRGRSCDSLNNRCEGSSVQTRTCHIQECDKRFKQDGGWSHWSPWSSCSVTCGDGVITRIRLCNSPSPQMNGKPCEGEARETKACKKDACPINGGWGPWSPWDICSVTCGGGVQKRSRLCNNPTPQFGGKDCVGDVTENQICNKQDCPIDGCLSNPCFAGVKCTSYPDGSWKCGACPPGYSGNGIQCTDVDECKEVPDACFNHNGEHRCENTDPGYNCLPCPPRFTGSQPFGQGVEHATANKQVCKPRNPCTDGTHDCNKNAKCNYLGHYSDPMYRCECKPGYAGNGIICGEDTDLDGWPNENLVCVANATYHCKKDNCPNLPNSGQEDYDKDGIGDACDDDDDNDKIPDDRDNCPFHYNPAQYDYDRDDVGDRCDNCPYNHNPDQADTDNNGEGDACAADIDGDGILNERDNCQYVYNVDQRDTDMDGVGDQCDNCPLEHNPDQLDSDSDRIGDTCDNNQDIDEDGHQNNLDNCPYVPNANQADHDKDGKGDACDHDDDNDGIPDDKDNCRLVPNPDQKDSDGDGRGDACKDDFDHDSVPDIDDICPENVDISETDFRRFQMIPLDPKGTSQNDPNWVVRHQGKELVQTVNCDPGLAVGYDEFNAVDFSGTFFINTERDDDYAGFVFGYQSSSRFYVVMWKQVTQSYWDTNPTRAQGYSGLSVKVVNSTTGPGEHLRNALWHTGNTPGQVRTLWHDPRHIGWKDFTAYRWRLSHRPKTGFIRVVMYEGKKIMADSGPIYDKTYAGGRLGLFVFSQEMVFFSDLKYECRDP

SEQ ID NO: 89 - DNA, 2974 bp, Homo sapiens
agaagccccgcagccgccgcgcggagaacagcgacagccgagcgcccggtccgcctgtctgccggtgggtctgcctgcccgcgcagcagacccggggcggccgcgggagcccgcgccccgcccgccgcgcctctgccgggacccacccgcagcggagggctgagcccgccggcggctccccggagctcacccacctccgcgcgccggagcgcaggcaaaaggggaggaaaggctcctctctttagtcaccactctcgccctctccaagaatttgtttaacaaagcgctgaggaaagagaacgtcttcttgaattctttagtaggggcggagtctgctgctgccctgcgctgccacctcggctacactgccctccgcgacgacccctgaccagccggggtcacgtccgggagacgggatcatgaagcgctcggtagccgtctggctcttggtcgggctcagcctcggtgtcccccagttcggcaaaggtgatatttgtgatcccaatccatgtgaaaatggaggtatctgtttgccaggattggctgatggttccttttcctgtgagtgtccagatggcttcacagaccccaactgttctagtgttgtggaggttgcatcagatgaagaagaaccaacttcagcaggtccctgcactcctaatccatgccataatggaggaacctgtgaaataagtgaagcataccgaggggatacattcataggctatgtttgtaaatgtccccgaggatttaatgggattcactgtcagcacaacataaatgaatgcgaagttgagccttgcaaaaatggtggaatatgtacagatcttgttgctaactattcctgtgagtgcccaggcgaatttatgggaagaaattgtcaatacaaatgctcaggcccactgggaattgaaggtggaattatatcaaaccagcaaatcacagcttcctctactcaccgagctctttttggactccaaaaatggtatccctactatgcacgtcttaataagaaggggcttataaatgcgtggacagctgcagaaaatgacagatggccgtggattcagataaatttgcaaaggaaaatgagagttactggtgtgattacccaaggagccaagaggattggaagcccagagtatataaaatcctacaaaattgcctacagtaatgatggaaagacttgggcaatgtacaaagtgaaaggcaccaatgaagacatggtgtttcgtggaaacattgataacaacactccatatgctaactctttcacaccccccataaaagctcagtatgtaagactctatccccaagtttgtcgaagacattgcactttgcgaatggaacttcttggctgtgaactgtcgggttgttctgagcctctgggtatgaaatcaggacatatacaagactatcagatcactgcctccagcatcttcagaacgctcaacatggacatgttcacttgggaaccaaggaaagctcggctggacaagcaaggcaaagtgaatgcctggacctctggccacaatgaccagtcacaatggttacaggtggatcttcttgttccaaccaaagtgactggcatcattacacaaggagctaaagattttggtcatgtacagtttgttggctcctacaaactggcttacagcaatgatggagaacactggactgtataccaggatgaaaagcaaagaaaagataaggttttccagggaaattttgacaatgacactcacagaaaaaatgtcatcgaccctcccatctatgcacgacacataagaatccttccttggtcctggtacgggaggatcacattgcggtcagagctgctgggctgcacagaggaggaatgaggggaggctacatttcacaaccctcttccctatttccctaaaagtatctccatggaatgaactgtgcaaaatctgtaggaaactgaatggtttttttttttttttcatgaaaaagtgctcaaattatggtaggcaactaacggtgtttttaagggggtctaagcctgccttttcaatgatttaatttgattttattttatccgtcaaatctcttaagtaacaacacattaagtgtgaattacttttctctcattgtttcctgaattattcgcattggtagaaatatattagggaaagaaagtagccttctttttatagcaagagtaaaaaagtctcaaagtcatcaaataagagcaagagttgatagagcttttacaatcaatactcacctaattctgataaaaggaatactgcaatgttagcaataagtttttttcttctgtaatgactctacgttatcctgtttccctgtgcctaccaaacactgtcaatgtttattacaaaattttaaagaagaatatgtaacatgcagtactgatattataattctcattttactttcattatttctaataagagattatgtgacttctttttcttttagttctattctacattcttaatattgtatattacctgaataattcaatttttttctaattgaatttcctattagttgactaaaagaagtgtcatgtttactcatatatgtagaacatgactgcctatcagtagattgatctgtatttaatattcgttaattaaatctgcagttttatttttgaaggaagccataactatttaatttccaaataattgcttcataaagaatcccatactctcagtttgcacaaaagaacaaaaaatatatatgtctctttaaatttaaatcttcatttagatggtaattacatatccttatatttactttaaaaaatcggcttatttgtttattttataaaaaatttagcaaagaaatattaatatagtgctgcatagtttggccaagcatactcatcatttctttgttcagctccacatttcctgtgaaactaacatcttattgagatttgaaactggtggtagtttcccaggaaggcacaggtggagtt

SEQ ID NO: 90 - protein, 480 aa, Homo sapiens
MKRSVAVWLLVGLSLGVPQFGKGDICDPNPCENGGICLPGLADGSFSCECPDGFTDPNCSSVVEVASDEEEPTSAGPCTPNPCHNGGTCEISEAYRGDTFIGYVCKCPRGFNGIHCQHNINECEVEPCKNGGICTDLVANYSCECPGEFMGRNCQYKCSGPLGIEGGIISNQQITASSTHRALFGLQKWYPYYARLNKKGLINAWTAAENDRWPWIQINLQRKMRVTGVITQGAKRIGSPEYIKSYKIAYSNDGKTWAMYKVKGTNEDMVFRGNIDNNTPYANSFTPPIKAQYVRLYPQVCRRHCTLRMELLGCELSGCSEPLGMKSGHIQDYQITASSIFRTLNMDMFTWEPRKARLDKQGKVNAWTSGHNDQSQWLQVDLLVPTKVTGIITQGAKDFGHVQFVGSYKLAYSNDGEHWTVYQDEKQRKDKVFQGNFDNDTHRKNVIDPPIYARHIRILPWSWYGRITLRSELLGCTEEE

SEQ ID NO: 91 - DNA, 1606 bp, Homo sapiens
aaatgtgaccggccgcggctccggcagtcaacgcctgcctcctctcgagcgtcctcagcgcagccgccgcccgcggagccagcacgaacgagcccagcaccggccggatggagcgtccgcaacccgacagcatgccccaggatttgtcagaggccctgaaggaggccaccaaggaggtgcacacccaggcagagaatgctgagttcatgaggaactttcagaagggccaggtgacccgagacggcttcaagctggtgatggcctccctgtaccacatctatgtggccctggaggaggagattgagcgcaacaaggagagcccagtcttcgcccctgtctacttcccagaagagctgcaccgcaaggctgccctggagcaggacctggccttctggtacgggccccgctggcaggaggtcatcccctacacaccagccatgcagcgctatgtgaagcggctccacgaggtggggcgcacagagcccgagctgctggtggcccacgcctacacccgctacctgggtgacctgtctgggggccaggtgctcaaaaagattgcccagaaagccctggacctgcccagctctggcgagggcctggccttcttcaccttccccaacattgccagtgccaccaagttcaagcagctctaccgctcccgcatgaactccctggagatgactcccgcagtcaggcagagggtgatagaagaggccaagactgcgttcctgctcaacatccagctctttgaggagttgcaggagctgctgacccatgacaccaaggaccagagcccctcacgggcaccagggcttcgccagcgggccagcaacaaagtgcaagattctgcccccgtggagactcccagagggaagcccccactcaacacccgctcccaggctccgcttctccgatgggtccttacactcagctttctggtggcgacagttgctgtagggctttatgccatgtgaatgcaggcatgctggctcccagggccatgaactttgtccggtggaaggccttctttctagagagggaattctcttggctggcttccttaccgtgggcactgaaggctttcagggcctccagccctctcactgtgtccctctctctggaaaggaggaaggagcctatggcatcttccccaacgaaaagcacatccaggcaatggcctaaacttcagagggggcgaagggatcagccctgcccttcagcatcctcagttcctgcagcagagcctggaagacaccctaatgtggcagctgtctcaaacctccaaaagccctgagtttcaagtatccttgttgacacggccatgaccactttccccgtgggccatggcaatttttacacaaacctgaaaagatgttgtgtcttgtgtttttgtcttatttttgttggagccactctgttcctggctcagcctcaaatgcagtatttttgttgtgttctgttgtttttatagcagggttggggtggtttttgagccatgcgtgggtggggagggaggtgtttaacggcactgtggccttggtctaacttttgtgtgaaataataaacaacattgtctgatagtagcttgaaaaaaaaaaaaaaaaaa

SEQ ID NO: 92 - protein, 288 aa, Homo sapiens
MERPQPDSMPQDLSEALKEATKEVHTQAENAEFMRNFQKGQVTRDGFKLVMASLYHIYVALEEEIERNKESPVFAPVYFPEELHRKAALEQDLAFWYGPRWQEVIPYTPAMQRYVKRLHEVGRTEPELLVAHAYTRYLGDLSGGQVLKKIAQKALDLPSSGEGLAFFTFPNIASATKFKQLYRSRMNSLEMTPAVRQRVIEEAKTAFLLNIQLFEELQELLTHDTKDQSPSRAPGLRQRASNKVQDSAPVETPRGKPPLNTRSQAPLLRWVLTLSFLVATVAVGLYAM

SEQ ID NO: 93 - DNA, 2585 bp, Homo sapiens
gcggaagttatttttcccccggccggcagggagttgtagttatctttgaaagccttctctctcttttggcataggcgggaaatgtggcgtcaagaggctgggattccgagaaagaagcgaggctttcacgaaaatgcgagcggcttcggcaaggggcggggccgctggacgtggatgaaagctacagagccagcgtggaccaatcagacctctttggggcggggcctctgtggataagtgggcgtggtctaggggggaagtcaccaagaacgcaccggaggtccttgcccgccctggaaaacgccctctgcggtgaaggagagaccacactgccatgcctccctctgggccccgaggaaccctccttctgttgccgctgctgctgctgctcctgcttcgcgccgtgctggctgtccccctggagcgaggggcgcccaacaaggaggagacccctgcgactgagagtcccgacacaggcctgtactaccaccggtacctccaggaggtcatcgatgtactggagacggatgggcatttccgagagaagctgcaggctgccaatgcggaggacatcaagagcgggaagctgagccgagagctggactttgtcagccaccacgtccgcaccaagctggatgagctcaagcgacaggaggtgtcacggctgcggatgctgctcaaggccaagatggacgccgagcaggatcccaatgtacaggtggatcatctgaatctcctgaaacagtttgaacacctggaccctcagaaccagcatacattcgaggcccgcgacctggagctgctgatccagacggccacccgggaccttgcccagtacgacgcagcccatcatgaagagttcaagcgctacgagatgcttaaggaacacgagagacggcgttatctggagtcactgggagaggagcagagaaaggaggcggagaggaagctggaagagcaacagcgccggcaccgcgagcaccctaaagtcaacgtgcctggcagccaagcccagttgaaggaggtgtgggaggagctggatggactggaccccaacaggtttaaccccaagaccttcttcatactgcatgatatcaacagtgatggtgtcctggatgagcaggagctggaggcactcttcaccaaggagctggagaaagtgtacgacccaaagaatgaggaggacgacatgcgggagatggaggaggagcgactgcgcatgcgggagcatgtgatgaagaatgtggacaccaaccaggaccgcctcgtgaccctggaggagttcctcgcatccactcagaggaaggagtttggggacaccggggagggctgggagacagtggagatgcaccctgcctacaccgaggaagagctgaggcgctttgaagaggagctggctgcccgggaggcagagctgaatgccaaggcccagcgcctcagccaggagacagaggctctagggcggtcccagggccgcctggaggcccagaagagagagctgcagcaggctgtgctgcacatggagcagcggaagcagcagcagcagcagcagcaaggccacaaggccccggctgcccaccctgaggggcagctcaagttccacccagacacagacgatgtacctgtcccagctccagccggtgaccagaaggaggtggacacttcagaaaagaaacttctcgagcggctccctgaggttgaggtgccccagcatctgtgatcctccgggaccccagccctcaggattcctgatgctccaaggcgactgatgggcgctggatgaagtggcacagtcagcttccctgggggctggtgtcatgttgggctcctggggcgggggcacggcctggcatttcacgcattgctgccaccccaggtccacctgtctccactttcacagcctccaagtctgtggctcttcccttctgtcctccgaggggcttgccttctctcgtgtccagtgaggtgctcagtgatcggcttaacttagagaagcccgccccctccccttctccgtctgtcccaagagggtctgctctgagcctgcgttcctaggtggctcggcctcagctgcctgggttgtggccgccctagcatcctgtatgcccacagctactggaatccccgctgctgctccgggccaagcttctggttgattaatgagggcatggggtggtccctcaagaccttcccctaccttttgtggaaccagtgatgcctcaaagacagtgtcccctccacagctgggtgccaggggcaggggatcctcagtatagccggtgaaccctgataccaggagcctgggcctccctgaacccctggcttccagccatctcatcgccagcctcctcctggacctcttggcccccagccccttccccacacagccccagaagggtcccagagctgaccccactccaggacctaggcccagcccctcagcctcatctggagcccctgaagaccagtcccacccacctttctggcctcatctgacactgctccgcatcctgctgtgtgtcctgttccatgttccggttccatccaaatacactttctggaacaaatgcatggctccaaaaaaa

SEQ ID NO: 94 - protein, 461 aa, Homo sapiens
MPPSGPRGTLLLLPLLLLLLLRAVLAVPLERGAPNKEETPATESPDTGLYYHRYLQEVIDVLETDGHFREKLQAANAEDIKSGKLSRELDFVSHHVRTKLDELKRQEVSRLRMLLKAKMDAEQDPNVQVDHLNLLKQFEHLDPQNQHTFEARDLELLIQTATRDLAQYDAAHHEEFKRYEMLKEHERRRYLESLGEEQRKEAERKLEEQQRRHREHPKVNVPGSQAQLKEVWEELDGLDPNRFNPKTFFILHDINSDGVLDEQELEALFTKELEKVYDPKNEEDDMREMEEERLRMREHVMKNVDTNQDRLVTLEEFLASTQRKEFGDTGEGWETVEMHPAYTEEELRRFEEELAAREAELNAKAQRLSQETEALGRSQGRLEAQKRELQQAVLHMEQRKQQQQQQQGHKAPAAHPEGQLKFHPDTDDVPVPAPAGDQKEVDTSEKKLLERLPEVEVPQHL

SEQ ID NO: 95 - DNA, 1067 bp, Homo sapiens
ggcggacgctccacgtgtccctcgccgcgccccgtctacccgcccctgccctgaggaccctagtccaacatggcggcgcccagcggagggtggaacggcgtcggcgcgagcttgtgggccgcgctgctcctaggggccgtggcgctgaggccggcggaggcggtgtccgagcccacgacggtggcgtttgacgtgcggcccggcggcgtcgtgcattccttctcccataacgtgggcccgggggacaaatatacgtgtatgttcacttacgcctctcaaggagggaccaatgagcaatggcagatgagtctggggaccagcgaagaccaccagcacttcacctgcaccatctggaggccccaggggaagtcctatctgtacttcacacagttcaaggcagaggtgcggggcgctgagattgagtacgccatggcctactctaaagccgcatttgaaagggaaagtgatgtccctctgaaaactgaggaatttgaagtgaccaaaacagcagtggctcacaggcccggggcattcaaagctgagctgtccaagctggtgattgtggccaaggcatcgcgcactgagctgtgaccagcagccctgttgcgggtggcaccttctcatctccggtgaagctgaaggggcctgtgtccctgaaagggccagcacatcactggttttctaggagggactcttaagttttctacctgggctgacgttgccttgtccggaggggcttgcagggtggctgaagccctggggcagagaacagagggtccagggccctcctggctcccaacagcttctcagttcccacttcctgctgagctcttctggactcaggatcgcagatccggggcacaaagagggtggggaacatgggggctatgctggggaaagcagccatgctccccccgacctccagccgagcatccttcatgagcctgcagaactgctttcctatgtttacccaggggacctcctttcagatgaactgggaagagatgaaatgttttttcatatttaaataaataagaacattaaaaagcaaaaaaaaaaaaaaaaaa

SEQ ID NO: 96 - protein, 173 aa, Homo sapiens
MAAPSGGWNGVGASLWAALLLGAVALRPAEAVSEPTTVAFDVRPGGVVHSFSHNVGPGDKYTCMFTYASQGGTNEQWQMSLGTSEDHQHFTCTIWRPQGKSYLYFTQFKAEVRGAEIEYAMAYSKAAFERESDVPLKTEEFEVTKTAVAHRPGAFKAELSKLVIVAKASRTEL

SEQ ID NO: 97 - DNA, 2029 bp, Homo sapiens
ccgagggtgacactcgggcttgggacagggcgtgctgccgcgggtcacgtgctgcggaggcttggggaggggcggcgaggcggggtttatagcccgggcgcccgcgggccccacgctttgaccgggtcgtggcagccggagtcgtcttcgggacgcgcctgctcttcgcctttcgctgcagtccgtcgatttctttctccaggaagaaaaatggcatccgttgcagttgatccacaaccgagtgtggtgactcgggtggtcaacctgcccttggtgagctccacgtatgacctcatgtcctcagcctatctcagtacaaaggaccagtatccctacctgaagtctgtgtgtgagatggcagagaacggtgtgaagaccatcacctccgtggccatgaccagtgctctgcccatcatccagaagctagagccgcaaattgcagttgccaatacctatgcctgtaaggggctagacaggattgaggagagactgcctattctgaatcagccatcaactcagattgttgccaatgccaaaggcgctgtgactggggcaaaagatgctgtgacgactactgtgactggggccaaggattctgtggccagcacgatcacaggggtgatggacaagaccaaaggggcagtgactggcagtgtggagaagaccaagtctgtggtcagtggcagcattaacacagtcttggggagtcggatgatgcagctcgtgagcagtggcgtagaaaatgcactcaccaaatcagagctgttggtagaacagtacctccctctcactgaggaagaactagaaaaagaagcaaaaaaagttgaaggatttgatctggttcagaagccaagttattatgttagactgggatccctgtctaccaagcttcactcccgtgcctaccagcaggctctcagcagggttaaagaagctaagcaaaaaagccaacagaccatttctcagctccattctactgttcacctgattgaatttgccaggaagaatgtgtatagtgccaatcagaaaattcaggatgctcaggataagctctacctctcatgggtagagtggaaaaggagcattggatatgatgatactgatgagtcccactgtgctgagcacattgagtcacgtactcttgcaattgcccgcaacctgactcagcagctccagaccacgtgccacaccctcctgtccaacatccaaggtgtaccacagaacatccaagatcaagccaagcacatgggggtgatggcaggcgacatctactcagtgttccgcaatgctgcctcctttaaagaagtgtctgacagcctcctcacttctagcaaggggcagctgcagaaaatgaaggaatctttagatgacgtgatggattatcttgttaacaacacgcccctcaactggctggtaggtcccttttatcctcagctgactgagtctcagaatgctcaggaccaaggtgcagagatggacaagagcagccaggagacccagcgatctgagcataaaactcattaaacctgcccctatcactagtgcatgctgtggccagacagatgacaccttttgttatgttgaaattaacttgctaggcaaccctaaattgggaagcaagtagctagtataaaggccctcaattgtagttgtttccagctgaattaagagctttaaagtttctggcattagcagatgatttctgttcacctggtaagaaaagaatgataggcttgtcagagcctatagccagaactcagaaaaaattcaaatgcacttatgttctcattctatggccattgtgttgcctctgttactgtttgtattgaataaaaacatcttcatgtgggctggggtagaaactggtgtctgctctggtgtgatctgaaaaggcgtcttcactgctttatctcatgatgcttgcttgtaaaacttgattttagtttttcatttctcaaataggaatactacctttgaattcaataaaattcactgcaggatagaccagttaaaaaaaaaaaaaaaaaaa

SEQ ID NO: 98 - protein, 437 aa, Homo sapiens
MASVAVDPQPSVVTRVVNLPLVSSTYDLMSSAYLSTKDQYPYLKSVCEMAENGVKTITSVAMTSALPIIQKLEPQIAVANTYACKGLDRIEERLPILNQPSTQIVANAKGAVTGAKDAVTTTVTGAKDSVASTITGVMDKTKGAVTGSVEKTKSVVSGSINTVLGSRMMQLVSSGVENALTKSELLVEQYLPLTEEELEKEAKKVEGFDLVQKPSYYVRLGSLSTKLHSRAYQQALSRVKEAKQKSQQTISQLHSTVHLIEFARKNVYSANQKIQDAQDKLYLSWVEWKRSIGYDDTDESHCAEHIESRTLAIARNLTQQLQTTCHTLLSNIQGVPQNIQDQAKHMGVMAGDIYSVFRNAASFKEVSDSLLTSSKGQLQKMKESLDDVMDYLVNNTPLNWLVGPFYPQLTESQNAQDQGAEMDKSSQETQRSEHKTH

SEQ ID NO: 99 - DNA, 1950 bp, Homo sapiens
tctggcattgcaagcctcgcttcgttgccacttcccagctcttcccgccttccgcggtataatcaacactacgagagatagagccgcctagaaccagtccggaggctgcggctgcagaagtaccgcctgcggagtaactgcaaagatgctgtccgtgcgcgttgctgcggccgtggtccgcgcccttcctcggcgggccggactggtctccagaaatgctttgggttcatctttcattgctgcaaggaacttccatgcctctaacactcatcttcaaaagactgggactgctgagatgtcctctattcttgaagagcgtattcttggagctgatacctctgttgatcttgaagaaactgggcgtgtcttaagtattggtgatggtattgcccgcgtacatgggctgaggaatgttcaagcagaagaaatggtagagttttcttcaggcttaaagggtatgtccttgaacttggaacctgacaatgttggtgttgtcgtgtttggaaatgataaactaattaaggaaggagatatagtgaagaggacaggagccattgtggacgttccagttggtgaggagctgttgggtcgtgtagttgatgcccttggtaatgctattgatggaaagggtccaattggttccaagacgcgtaggcgagttggtctgaaagcccccggtatcattcctcgaatttcagtgcgggaaccaatgcagactggcattaaggctgtggatagcttggtgccaattggtcgtggtcagcgtgaactgattattggtgaccgacagactgggaaaacctcaattgctattgacacaatcattaaccagaaacgtttcaatgatggatctgatgaaaagaagaagctgtactgtatttatgttgctattggtcaaaagagatccactgttgcccagttggtgaagagacttacagatgcagatgccatgaagtacaccattgtggtgtcggctacggcctcggatgctgccccacttcagtacctggctccttactctggctgttccatgggagagtattttagagacaatggcaaacatgctttgatcatctatgacgacttatccaaacaggctgttgcttaccgtcagatgtctctgttgctccgccgaccccctggtcgtgaggcctatcctggtgatgtgttctacctacactcccggttgctggagagagcagccaaaatgaacgatgcttttggtggtggctccttgactgctttgccagtcatagaaacacaggctggtgatgtgtctgcttacattccaacaaatgtcatttccatcactgacggacagatcttcttggaaacagaattgttctacaaaggtatccgccctgcaattaacgttggtctgtctgtatctcgtgtcggatccgctgcccaaaccagggctatgaagcaggtagcaggtaccatgaagctggaattggctcagtatcgtgaggttgctgcttttgcccagttcggttctgacctcgatgctgccactcaacaacttttgagtcgtggcgtgcgtctaactgagttgctgaagcaaggacagtattctcccatggctattgaagaacaagtggctgttatctatgcgggtgtaaggggatatcttgataaactggagcccagcaagattacaaagtttgagaatgctttcttgtctcatgtcgtcagccagcaccaagccttgttgggcactatcagggctgatggaaagatctcagaacaatcagatgcaaagctgaaagagattgtaacaaatttcttggctggatttgaagcttaaactcctgtggattcacatcaaataccagttcagttttgtcattgttctagtaaattagttccatttgtaaaagggttactctcatactccttatgtacagaaatcacatgaaaaataaaggttccataatgcatagttaaaaa

SEQ ID NO: 100 - protein, 553 aa, Homo sapiens
MLSVRVAAAVVRALPRRAGLVSRNALGSSFIAARNFHASNTHLQKTGTAEMSSILEERILGADTSVDLEETGRVLSIGDGIARVHGLRNVQAEEMVEFSSGLKGMSLNLEPDNVGVVVFGNDKLIKEGDIVKRTGAIVDVPVGEELLGRVVDALGNAIDGKGPIGSKTRRRVGLKAPGIIPRISVREPMQTGIKAVDSLVPIGRGQRELIIGDRQTGKTSIAIDTIINQKRFNDGSDEKKKLYCIYVAIGQKRSTVAQLVKRLTDADAMKYTIVVSATASDAAPLQYLAPYSGCSMGEYFRDNGKHALIIYDDLSKQAVAYRQMSLLLRRPPGREAYPGDVFYLHSRLLERAAKMNDAFGGGSLTALPVIETQAGDVSAYIPTNVISITDGQIFLETELFYKGIRPAINVGLSVSRVGSAAQTRAMKQVAGTMKLELAQYREVAAFAQFGSDLDAATQQLLSRGVRLTELLKQGQYSPMAIEEQVAVIYAGVRGYLDKLEPSKITKFENAFLSHVVSQHQALLGTIRADGKISEQSDAKLKEIVTNFLAGFEA

SEQ ID NO: 101 - DNA, 1927 bp, Homo sapiens
ggggcagtacttccgggtcaggtgggccggctgtcttgaccttctttgcggctcggccattttgtcccagtcagtccggaggctgcggctgcagaagtaccgcctgcggagtaactgcaaagatgctgtccgtgcgcgttgctgcggccgtggtccgcgcccttcctcggcgggccggactggtctccagaaatgctttgggttcatctttcattgctgcaaggaacttccatgcctctaacactcatcttcaaaagactgggactgctgagatgtcctctattcttgaagagcgtattcttggagctgatacctctgttgatcttgaagaaactgggcgtgtcttaagtattggtgatggtattgcccgcgtacatgggctgaggaatgttcaagcagaagaaatggtagagttttcttcaggcttaaagggtatgtccttgaacttggaacctgacaatgttggtgttgtcgtgtttggaaatgataaactaattaaggaaggagatatagtgaagaggacaggagccattgtggacgttccagttggtgaggagctgttgggtcgtgtagttgatgcccttggtaatgctattgatggaaagggtccaattggttccaagacgcgtaggcgagttggtctgaaagcccccggtatcattcctcgaatttcagtgcgggaaccaatgcagactggcattaaggctgtggatagcttggtgccaattggtcgtggtcagcgtgaactgattattggtgaccgacagactgggaaaacctcaattgctattgacacaatcattaaccagaaacgtttcaatgatggatctgatgaaaagaagaagctgtactgtatttatgttgctattggtcaaaagagatccactgttgcccagttggtgaagagacttacagatgcagatgccatgaagtacaccattgtggtgtcggctacggcctcggatgctgccccacttcagtacctggctccttactctggctgttccatgggagagtattttagagacaatggcaaacatgctttgatcatctatgacgacttatccaaacaggctgttgcttaccgtcagatgtctctgttgctccgccgaccccctggtcgtgaggcctatcctggtgatgtgttctacctacactcccggttgctggagagagcagccaaaatgaacgatgcttttggtggtggctccttgactgctttgccagtcatagaaacacaggctggtgatgtgtctgcttacattccaacaaatgtcatttccatcactgacggacagatcttcttggaaacagaattgttctacaaaggtatccgccctgcaattaacgttggtctgtctgtatctcgtgtcggatccgctgcccaaaccagggctatgaagcaggtagcaggtaccatgaagctggaattggctcagtatcgtgaggttgctgcttttgcccagttcggttctgacctcgatgctgccactcaacaacttttgagtcgtggcgtgcgtctaactgagttgctgaagcaaggacagtattctcccatggctattgaagaacaagtggctgttatctatgcgggtgtaaggggatatcttgataaactggagcccagcaagattacaaagtttgagaatgctttcttgtctcatgtcgtcagccagcaccaagccttgttgggcactatcagggctgatggaaagatctcagaacaatcagatgcaaagctgaaagagattgtaacaaatttcttggctggatttgaagcttaaactcctgtggattcacatcaaataccagttcagttttgtcattgttctagtaaattagttccatttgtaaaagggttactctcatactccttatgtacagaaatcacatgaaaaataaaggttccataatgcatagttaaaaa

SEQ ID NO: 102 - protein, 553 aa, Homo sapiens; identical to SEQ ID NO: 100

SEQ ID NO: 103 - DNA, 1861 bp, Homo sapiens
ggggcagtacttccgggtcaggtgggccggctgtcttgaccttctttgcggctcggccattttgtcccagtcagtccggaggctgcggctgcagaagtaccgcctgcggagtaactgcaaagatgctgtccgtgcgcgttgctgcggccgtggtccgcgcccttcctcggcgggccggactggtctccagaaatgctttgggttcatctttcattgctgcaaggaacttccatgcctctaacactcatcttcaaaagactgggactgctgagatgtcctctattcttgaagagcgtattcttggagctgatacctctgttgatcttgaagaaactgggcgtgtcttaagtattggtgatggtattgcccgcgtacatgggctgaggaatgttcaagcagaagaaatggtagagttttcttcaggcttaaagggtatgtccttgaacttggaacctgacaatgttggtgttgtcgtgtttggaaatgataaactaattaaggaaggagatatagtgaagaggacaggagccattgtggacggtccaattggttccaagacgcgtaggcgagttggtctgaaagcccccggtatcattcctcgaatttcagtgcgggaaccaatgcagactggcattaaggctgtggatagcttggtgccaattggtcgtggtcagcgtgaactgattattggtgaccgacagactgggaaaacctcaattgctattgacacaatcattaaccagaaacgtttcaatgatggatctgatgaaaagaagaagctgtactgtatttatgttgctattggtcaaaagagatccactgttgcccagttggtgaagagacttacagatgcagatgccatgaagtacaccattgtggtgtcggctacggcctcggatgctgccccacttcagtacctggctccttactctggctgttccatgggagagtattttagagacaatggcaaacatgctttgatcatctatgacgacttatccaaacaggctgttgcttaccgtcagatgtctctgttgctccgccgaccccctggtcgtgaggcctatcctggtgatgtgttctacctacactcccggttgctggagagagcagccaaaatgaacgatgcttttggtggtggctccttgactgctttgccagtcatagaaacacaggctggtgatgtgtctgcttacattccaacaaatgtcatttccatcactgacggacagatcttcttggaaacagaattgttctacaaaggtatccgccctgcaattaacgttggtctgtctgtatctcgtgtcggatccgctgcccaaaccagggctatgaagcaggtagcaggtaccatgaagctggaattggctcagtatcgtgaggttgctgcttttgcccagttcggttctgacctcgatgctgccactcaacaacttttgagtcgtggcgtgcgtctaactgagttgctgaagcaaggacagtattctcccatggctattgaagaacaagtggctgttatctatgcgggtgtaaggggatatcttgataaactggagcccagcaagattacaaagtttgagaatgctttcttgtctcatgtcgtcagccagcaccaagccttgttgggcactatcagggctgatggaaagatctcagaacaatcagatgcaaagctgaaagagattgtaacaaatttcttggctggatttgaagcttaaactcctgtggattcacatcaaataccagttcagttttgtcattgttctagtaaattagttccatttgtaaaagggttactctcatactccttatgtacagaaatcacatgaaaaataaaggttccataatgcatagttaaaaa

SEQ ID NO: 104 - protein, 531 aa, Homo sapiens
MLSVRVAAAVVRALPRRAGLVSRNALGSSFIAARNFHASNTHLQKTGTAEMSSILEERILGADTSVDLEETGRVLSIGDGIARVHGLRNVQAEEMVEFSSGLKGMSLNLEPDNVGVVVFGNDKLIKEGDIVKRTGAIVDGPIGSKTRRRVGLKAPGIIPRISVREPMQTGIKAVDSLVPIGRGQRELIIGDRQTGKTSIAIDTIINQKRFNDGSDEKKKLYCIYVAIGQKRSTVAQLVKRLTDADAMKYTIVVSATASDAAPLQYLAPYSGCSMGEYFRDNGKHALIIYDDLSKQAVAYRQMSLLLRRPPGREAYPGDVFYLHSRLLERAAKMNDAFGGGSLTALPVIETQAGDVSAYIPTNVISITDGQIFLETELFYKGIRPAINVGLSVSRVGSAAQTRAMKQVAGTMKLELAQYREVAAFAQFGSDLDAATQQLLSRGVRLTELLKQGQYSPMAIEEQVAVIYAGVRGYLDKLEPSKITKFENAFLSHVVSQHQALLGTIRADGKISEQSDAKLKEIVTNFLAGFEA

SEQ ID NO: 105 - DNA, 2000 bp, Homo sapiens
ggggcagtacttccgggtcaggtgggccggctgtcttgaccttctttgcggctcggccattttgtcccagtcagtccggaggctgcggctgcagaagtaccgcctgcggagtaactgcaaagatgctgtccgtgcgcgttgctgcggccgtggtccgcgcccttcctcggcgggccggactggtctccagaaatgctttgggttcatctttcattgctgcaaggaacttccatgcctctaacactcatcttcaaaagactggtaagttattatttctcagtctacgccgcacttactagatgaagatataaattacatacatcgtataactgtgggactgctgagatgtcctctattcttgaagagcgtattcttggagctgatacctctgttgatcttgaagaaactgggcgtgtcttaagtattggtgatggtattgcccgcgtacatgggctgaggaatgttcaagcagaagaaatggtagagttttcttcaggcttaaagggtatgtccttgaacttggaacctgacaatgttggtgttgtcgtgtttggaaatgataaactaattaaggaaggagatatagtgaagaggacaggagccattgtggacgttccagttggtgaggagctgttgggtcgtgtagttgatgcccttggtaatgctattgatggaaagggtccaattggttccaagacgcgtaggcgagttggtctgaaagcccccggtatcattcctcgaatttcagtgcgggaaccaatgcagactggcattaaggctgtggatagcttggtgccaattggtcgtggtcagcgtgaactgattattggtgaccgacagactgggaaaacctcaattgctattgacacaatcattaaccagaaacgtttcaatgatggatctgatgaaaagaagaagctgtactgtatttatgttgctattggtcaaaagagatccactgttgcccagttggtgaagagacttacagatgcagatgccatgaagtacaccattgtggtgtcggctacggcctcggatgctgccccacttcagtacctggctccttactctggctgttccatgggagagtattttagagacaatggcaaacatgctttgatcatctatgacgacttatccaaacaggctgttgcttaccgtcagatgtctctgttgctccgccgaccccctggtcgtgaggcctatcctggtgatgtgttctacctacactcccggttgctggagagagcagccaaaatgaacgatgcttttggtggtggctccttgactgctttgccagtcatagaaacacaggctggtgatgtgtctgcttacattccaacaaatgtcatttccatcactgacggacagatcttcttggaaacagaattgttctacaaaggtatccgccctgcaattaacgttggtctgtctgtatctcgtgtcggatccgctgcccaaaccagggctatgaagcaggtagcaggtaccatgaagctggaattggctcagtatcgtgaggttgctgcttttgcccagttcggttctgacctcgatgctgccactcaacaacttttgagtcgtggcgtgcgtctaactgagttgctgaagcaaggacagtattctcccatggctattgaagaacaagtggctgttatctatgcgggtgtaaggggatatcttgataaactggagcccagcaagattacaaagtttgagaatgctttcttgtctcatgtcgtcagccagcaccaagccttgttgggcactatcagggctgatggaaagatctcagaacaatcagatgcaaagctgaaagagattgtaacaaatttcttggctggatttgaagcttaaactcctgtggattcacatcaaataccagttcagttttgtcattgttctagtaaattagttccatttgtaaaagggttactctcatactccttatgtacagaaatcacatgaaaaataaaggttccataatgcatagttaaaaa

SEQ ID NO: 106 - protein, 503 aa, Homo sapiens
MSSILEERILGADTSVDLEETGRVLSIGDGIARVHGLRNVQAEEMVEFSSGLKGMSLNLEPDNVGVVVFGNDKLIKEGDIVKRTGAIVDVPVGEELLGRVVDALGNAIDGKGPIGSKTRRRVGLKAPGIIPRISVREPMQTGIKAVDSLVPIGRGQRELIIGDRQTGKTSIAIDTIINQKRFNDGSDEKKKLYCIYVAIGQKRSTVAQLVKRLTDADAMKYTIVVSATASDAAPLQYLAPYSGCSMGEYFRDNGKHALIIYDDLSKQAVAYRQMSLLLRRPPGREAYPGDVFYLHSRLLERAAKMNDAFGGGSLTALPVIETQAGDVSAYIPTNVISITDGQIFLETELFYKGIRPAINVGLSVSRVGSAAQTRAMKQVAGTMKLELAQYREVAAFAQFGSDLDAATQQLLSRGVRLTELLKQGQYSPMAIEEQVAVIYAGVRGYLDKLEPSKITKFENAFLSHVVSQHQALLGTIRADGKISEQSDAKLKEIVTNFLAGFEA

SEQ ID NO: 107 - DNA, 2263 bp, Homo sapiens
ggggcagtacttccgggtcaggtgggccggctgtcttgaccttctttgcggctcggccattttgtcccagtcagtccggaggctgcggctgcagaagtaccgcctgcggagtaactgcaaagatgctgtccgtgcgcgttgctgcggccgtggtccgcgcccttcctcggcgggccggactggtgagcaccgaaggccggcatgatgcaggcggccgggtggggctgcagggtggtggtgcgccggctcgggcgctctctgcaggagggcgaggggctgtggcgaatgccgccatcttgcacccgtggcttctccggctggacagagcaggcgacacaggtgcccttttgctcgtcacctgcgcagaggcagaatggtacagggcagacagttaactcgatggtgtccagagacagggcctcaagattcctgtcttcggctgacagcggccctagaagggggatcttgggtgaaggtcagggcttgggcgctagctctccgaggcctgttctgaatcggtctccagaaatgctttgggttcatctttcattgctgcaaggaacttccatgcctctaacactcatcttcaaaagactgggactgctgagatgtcctctattcttgaagagcgtattcttggagctgatacctctgttgatcttgaagaaactgggcgtgtcttaagtattggtgatggtattgcccgcgtacatgggctgaggaatgttcaagcagaagaaatggtagagttttcttcaggcttaaagggtatgtccttgaacttggaacctgacaatgttggtgttgtcgtgtttggaaatgataaactaattaaggaaggagatatagtgaagaggacaggagccattgtggacgttccagttggtgaggagctgttgggtcgtgtagttgatgcccttggtaatgctattgatggaaagggtccaattggttccaagacgcgtaggcgagttggtctgaaagcccccggtatcattcctcgaatttcagtgcgggaaccaatgcagactggcattaaggctgtggatagcttggtgccaattggtcgtggtcagcgtgaactgattattggtgaccgacagactgggaaaacctcaattgctattgacacaatcattaaccagaaacgtttcaatgatggatctgatgaaaagaagaagctgtactgtatttatgttgctattggtcaaaagagatccactgttgcccagttggtgaagagacttacagatgcagatgccatgaagtacaccattgtggtgtcggctacggcctcggatgctgccccacttcagtacctggctccttactctggctgttccatgggagagtattttagagacaatggcaaacatgctttgatcatctatgacgacttatccaaacaggctgttgcttaccgtcagatgtctctgttgctccgccgaccccctggtcgtgaggcctatcctggtgatgtgttctacctacactcccggttgctggagagagcagccaaaatgaacgatgcttttggtggtggctccttgactgctttgccagtcatagaaacacaggctggtgatgtgtctgcttacattccaacaaatgtcatttccatcactgacggacagatcttcttggaaacagaattgttctacaaaggtatccgccctgcaattaacgttggtctgtctgtatctcgtgtcggatccgctgcccaaaccagggctatgaagcaggtagcaggtaccatgaagctggaattggctcagtatcgtgaggttgctgcttttgcccagttcggttctgacctcgatgctgccactcaacaacttttgagtcgtggcgtgcgtctaactgagttgctgaagcaaggacagtattctcccatggctattgaagaacaagtggctgttatctatgcgggtgtaaggggatatcttgataaactggagcccagcaagattacaaagtttgagaatgctttcttgtctcatgtcgtcagccagcaccaagccttgttgggcactatcagggctgatggaaagatctcagaacaatcagatgcaaagctgaaagagattgtaacaaatttcttggctggatttgaagcttaaactcctgtggattcacatcaaataccagttcagttttgtcattgttctagtaaattagttccatttgtaaaagggttactctcatactccttatgtacagaaatcacatgaaaaataaaggttccataatgcatagttaaaaa

SEQ ID NO: 108 - protein, 503 aa, Homo sapiens; identical to SEQ ID NO: 106

SEQ ID NO: 109 - DNA, 2932 bp, Homo sapiens
aaatagtctactttccggtagcggtgccagggcagtggcctaatacggaactccatttcccggcgtgcctcgcggaggccgctgaactcagaagcgggaggccggttccggttgcatcagcgagggattcacggcgaaatgagactgttcgtgagtgatggcgtcccgggttgcttgccggtgctggccgccgccgggagagcccggggcagagcagaggtgctcatcagcactgtaggcccggaagattgtgtggtcccgttcctgacccggcctaaggtccctgtcttgcagctggatagcggcaactacctcttctccactagtgcaatctgccgatatttttttttgttatctggctgggagcaagatgacctcactaaccagtggctggaatgggaagcgacagagctgcagccagctttgtctgctgccctgtactatttagtggtccaaggcaagaagggggaagatgttcttggttcagtgcggagagccctgactcacattgaccacagcttgagtcgtcagaactgtcctttcctggctggggagacagaatctctagccgacattgttttgtggggagccctatacccattactgcaagatcccgcctacctccctgaggagctgagtgccctgcacagctggttccagacactgagtacccaggaaccatgtcagcgagctgcagagactgtactgaaacagcaaggtgtcctggctctccggccttacctccaaaagcagccccagcccagccccgctgagggaagggctgtcaccaatgagcctgaggaggaggagctggctaccctatctgaggaggagattgctatggctgttactgcttgggagaagggcctagaaagtttgcccccgctgcggccccagcagaatccagtgttgcctgtggctggagaaaggaatgtgctcatcaccagtgccctcccttacgtcaacaatgtcccccaccttgggaacatcattggttgtgtgctcagtgccgatgtctttgccaggtactctcgcctccgccagtggaacaccctctatctgtgtgggacagatgagtatggtacagcaacagagaccaaggctctggaggagggactaaccccccaggagatctgcgacaagtaccacatcatccatgctgacatctaccgctggtttaacatttcgtttgatatttttggtcgcaccaccactccacagcagaccaaaatcacccaggacattttccagcagttgctgaaacgaggttttgtgctgcaagatactgtggagcaactgcgatgtgagcactgtgctcgcttcctggctgaccgcttcgtggagggcgtgtgtcccttctgtggctatgaggaggctcggggtgaccagtgtgacaagtgtggcaagctcatcaatgctgtcgagcttaagaagcctcagtgtaaagtctgccgatcatgccctgtggtgcagtcgagccagcacctgtttctggacctgcctaagctggagaagcgactggaggagtggttggggaggacattgcctggcagtgactggacacccaatgcccagtttatcacccgttcttggcttcgggatggcctcaagccacgctgcataacccgagacctcaaatggggaacccctgtacccttagaaggttttgaagacaaggtattctatgtctggtttgatgccactattggctatctgtccatcacagccaactacacagaccagtgggagagatggtggaagaacccagagcaagtggacctgtatcagttcatggccaaagacaatgttcctttccatagcttagtctttccttgctcagccctaggagctgaggataactataccttggtcagccacctcattgctacagagtacctgaactatgaggatgggaaattctctaagagccgcggtgtgggagtgtttggggacatggcccaggacacggggatccctgctgacatctggcgcttctatctgctgtacattcggcctgagggccaggacagtgctttctcctggacggacctgctgctgaagaataattctgagctgcttaacaacctgggcaacttcatcaacagagctgggatgtttgtgtctaagttctttgggggctatgtgcctgagatggtgctcacccctgatgatcagcgcctgctggcccatgtcaccctggagctccagcactatcaccagctacttgagaaggttcggatccgggatgccttgcgcagtatcctcaccatatctcgacatggcaaccaatatattcaggtgaatgagccctggaagcggattaaaggcagtgaggctgacaggcaacgggcaggaacagtgactggcttggcagtgaatatagctgccttgctctctgtcatgcttcagccttacatgcccacggttagtgccacaatccaggcccagctgcagctcccacctccagcctgcagtatcctgctgacaaacttcctgtgtaccttaccagcaggacaccagattggcacagtcagtcccttgttccaaaaattggaaaatgaccagattgaaagtttaaggcagcgctttggagggggccaggcaaaaacgtccccgaagccagcagttgtagagactgttacaacagccaagccacagcagatacaagcgctgatggatgaagtgacaaaacaaggaaacattgtccgagaactgaaagcacaaaaggcagacaagaacgaggttgctgcggaggtggcgaaactcttggatctaaagaaacagttggctgtagctgaggggaaaccccctgaagcccctaaaggcaagaagaaaaagtaaaagaccttggctcatagaaagtcactttaatagatagggacagtaataaataaatgtacaatctctatatacaaaaaaaaaaaaaaaaaaa

SEQ ID NO: 110 - protein, 900 aa, Homo sapiens
MRLFVSDGVPGCLPVLAAAGRARGRAEVLISTVGPEDCVVPFLTRPKVPVLQLDSGNYLFSTSAICRYFFLLSGWEQDDLTNQWLEWEATELQPALSAALYYLVVQGKKGEDVLGSVRRALTHIDHSLSRQNCPFLAGETESLADIVLWGALYPLLQDPAYLPEELSALHSWFQTLSTQEPCQRAAETVLKQQGVLALRPYLQKQPQPSPAEGRAVTNEPEEEELATLSEEEIAMAVTAWEKGLESLPPLRPQQNPVLPVAGERNVLITSALPYVNNVPHLGNIIGCVLSADVFARYSRLRQWNTLYLCGTDEYGTATETKALEEGLTPQEICDKYHIIHADIYRWFNISFDIFGRTTTPQQTKITQDIFQQLLKRGFVLQDTVEQLRCEHCARFLADRFVEGVCPFCGYEEARGDQCDKCGKLINAVELKKPQCKVCRSCPVVQSSQHLFLDLPKLEKRLEEWLGRTLPGSDWTPNAQFITRSWLRDGLKPRCITRDLKWGTPVPLEGFEDKVFYVWFDATIGYLSITANYTDQWERWWKNPEQVDLYQFMAKDNVPFHSLVFPCSALGAEDNYTLVSHLIATEYLNYEDGKFSKSRGVGVFGDMAQDTGIPADIWRFYLLYIRPEGQDSAFSWTDLLLKNNSELLNNLGNFINRAGMFVSKFFGGYVPEMVLTPDDQRLLAHVTLELQHYHQLLEKVRIRDALRSILTISRHGNQYIQVNEPWKRIKGSEADRQRAGTVTGLAVNIAALLSVMLQPYMPTVSATIQAQLQLPPPACSILLTNFLCTLPAGHQIGTVSPLFQKLENDQIESLRQRFGGGQAKTSPKPAVVETVTTAKPQQIQALMDEVTKQGNIVRELKAQKADKNEVAAEVAKLLDLKKQLAVAEGKPPEAPKGKKKK

SEQ ID NO: 111 - DNA, 4693 bp, Homo sapiens
attccgagtacgagaaagcgaaaaagcccagactgaaaagggtactgagaaattacgactagtcttaaatgctcccttcgcttctcgggcctcgccacaccgcgcaggcgccccactggtccttaactctgttctttgacctcctgccccagccccctcctcttcagccacctagcgactcttccggtgctgtgaaggcggttccggttcgcggcggttcccgggttttgcgttccgcgcccggccggaaaccccttcgcatggcagccggttccggttcggactttgtatctttgctaaagtcagtgatgtgaaaagacttgaaatggatgatattgctgataggatgaggatggatgctggagaagtgactttagtgaaccacaactccgtattcaaaacccacctcctgccacaaacaggttttccagaggaccagctttcgctttctgaccagcagattttatcttccaggcaaggacatttggaccgatcttttacatgttccacaagaagtgcagcttataatccaagctattactcagataatccttcctcagacagttttcttggctcaggcgatttaagaacctttggccagagtgcaaatggccaatggagaaattctaccccatcgtcaagctcatctttacaaaaatcaagaaacagccgaagtctttacctcgaaacccgaaagacctcaagtggattatcaaacagttttgcgggaaagtcaaaccatcactgccatgtatctgcatatgaaaaatcttttcctattaaacctgttccaagtccatcttggagtggttcatgtcgtcgaagtcttttgagccccaagaaaactcagaggcgacatgttagtacagcagaagagacagttcaagaagaagaaagagagatttacagacagctgctacagatggtcacagggaaacagtttactatagccaaacccaccacacattttcctttacacctgtctcgatgtcttagttccagtaaaaatactttgaaagactcactgtttaaaaatggaaactcttgtgcatctcagatcattggctctgatacttcatcatctggatctgccagcattttaactaaccaggaacagctgtcccacagtgtatattccctatcttcttataccccagatgttgcatttggatccaaagattctggtactcttcatcatccccatcatcaccactctgttccacatcagccagataacttagcagcttcaaatacacaatctgaaggatcagactctgtgattttactgaaagtgaaagattcccagactccaactcccagttctactttcttccaggcagagctgtggatcaaagaattaactagtgtttatgattctcgagcacgagaaagattgcgccagattgaagaacagaaggcattggccttacagcttcaaaaccagagattgcaggagcgggaacattcagtacatgattcagtagaactacatcttcgtgtacctcttgaaaaggagattcctgttactgttgtccaagaaacacaaaaaaaaggtcataaattaactgatagtgaagatgaatttcctgaaattacagaggaaatggagaaagaaataaagaatgtatttcgtaatgggaatcaggatgaagttctcagtgaagcatttcgcctgaccattacacgcaaagatattcaaactctaaaccatctgaattggctcaatgatgagatcatcaatttctacatgaatatgctgatggagcgaagtaaagagaagggcttgccaagtgtgcatgcatttaatacctttttcttcactaaattaaaaacggctggttatcaggcagtgaaacgttggacaaagaaagtagatgtattttctgttgacattcttttggtgcccattcacctgggagtacactggtgtctagctgttgtggactttagaaagaagaatattacctattacgactccatgggtgggataaacaatgaagcctgcagaatactcttgcaatacctaaagcaagaaagcattgacaagaaaaggaaagagtttgacaccaatggctggcagcttttcagcaagaaaagccaggagattcctcagcagatgaatggaagtgactgtgggatgtttgcctgcaaatatgctgactgtattaccaaagacagaccaatcaacttcacacagcaacacatgccatacttccggaagcggatggtctgggagatcctccaccgaaaactcttgtgaagactgtctcacttagcagaccttgaccatgtgggggaccagctctttgttgtctacagccagagaccttggaaacagctgctcccagccctctgctgttgtaacacccttgatcctggaccaggccctggcgagatgcattcacaagcacatctgcctttccttttgtatctcagatactatttttgcaaagaaactttggtgctgtgaaaggggtgagggacatccctaagctgaagagagagactgcttttcacttcttcagttctgccatcttgttttcaaagggctccagcctcactcagtccctaattatgggactgagaaaagcttggaaagaatcttggtttcatataaattcttgttgttaggccttactaagaagtaggaaagggcatgggcaaaaggtagggataaaaaccaccagcatatacatggacatacacacacacccacacacacaaacacacacacacacacaattttcacgatgtatggtcaggaatgtgactgtaaactggactttggggcccaggcataagtcccttcctccaggacctttcctatttatatgtccctatacaaaatccatctgcttttatacgtagctgttttatcatctgtagcttcatcctatccggaggcacagcacatgagccctggacaggtcccaaagttccaagcagtcctttccgtgaaagcaggggtttgcatgtgctaccaacacatgatacggggaagacccacccagggagcggtttcagtggcgcaacaaagcaccacttttactgttgcctacttctgaccaagaagaaaaaggaccttagtatttagcataaaattccagcgctggatgaatgcagatctagtttggtctgtggctagtttaaatatgtttctaaccacagagaatttcatatatatatacatatatatatacacatacatatatatatatatatatgtatgtataaaatttcacagggatatgcttttttttttaaagactgaatgtgttcaccatttagcctgtagatttatttccattttccaaattccagcacacagagatcccagcccctatgagtagggtgtttgtggactacctaatggaatatttttgaggcctggatgaactttgccatatgggtagaggttacagagggaggtgatattttcagctaaaaaaaaaaacgggtggagtttggactgatcaacttgagatttaaaaactgctattccttttgttctttctagcatctctccccaccctctgagagctcctcaggcttagatagtgaagtgatcaaatgccagtgtcattttgtacttaagttccaaagtaggaacattttatacttttttctgtattgtaataggtagttttgtatgaaatcttttctcctctcccgttgtaccgcattctttccagcattgtgctttttccctgggcttatttgaaaattttactgttttatacaagctcgtttagtacatttttctatgttttaccacaagttacaatttgaaaagaaaactattttttttaaatattccattgttaactgaatgttactgtttccactccagcaactacatgtcctcccttcaactgcctgccttttggggaaagaccaccttttgtgtgtttgttttttctctctctttctttccctttctctttctatctctctttatttttctttctttttctttgtttttgagttttctataggaaataaatagctttctatatatgagttgctggggaccttcacattctcttttagaaagctgtggcatgcagtctcattgcaggactcctggaatattgtctggttcttggtatttactgtatgtaagcaacaacttgaaaggtggcaatatggtgtcgatttggactatgaatcaaaagacctttttcaggttctttcactattgtctgggggactcagaacaagattgttctctgtatttattgtttgtccatttaggtaacatctgtcttaccttcctcacagactttgtacagaccaaagcaacaaatatttattgccatgtatagcagaaaatgaaacatgcaacaaaagcactttgaaaaatatataaggaattgttgagcctgtctgaatttgggccccctttctgactaatgcagttttgcacaaggtagaagttagtgaccctgagaccatcttaccaccctggacctggtccaaatacagacttacacagtggaccattctttcctgagctagccaacaagagcaggagtagtatctggaaactttcccctttgtttaggggtaggctttgatgaccaggaaaaaaaaaaaggtatttctgcattttatggcccaaaggcatgttattaatatcttatgtaatttactttaaactaaataagacttttttctcctgtgtaaaaaaaaa

SEQ ID NO: 112 - protein, 644 aa, Homo sapiens
MDDIADRMRMDAGEVTLVNHNSVFKTHLLPQTGFPEDQLSLSDQQILSSRQGHLDRSFTCSTRSAAYNPSYYSDNPSSDSFLGSGDLRTFGQSANGQWRNSTPSSSSSLQKSRNSRSLYLETRKTSSGLSNSFAGKSNHHCHVSAYEKSFPIKPVPSPSWSGSCRRSLLSPKKTQRRHVSTAEETVQEEEREIYRQLLQMVTGKQFTIAKPTTHFPLHLSRCLSSSKNTLKDSLFKNGNSCASQIIGSDTSSSGSASILTNQEQLSHSVYSLSSYTPDVAFGSKDSGTLHHPHHHHSVPHQPDNLAASNTQSEGSDSVILLKVKDSQTPTPSSTFFQAELWIKELTSVYDSRARERLRQIEEQKALALQLQNQRLQEREHSVHDSVELHLRVPLEKEIPVTVVQETQKKGHKLTDSEDEFPEITEEMEKEIKNVFRNGNQDEVLSEAFRLTITRKDIQTLNHLNWLNDEIINFYMNMLMERSKEKGLPSVHAFNTFFFTKLKTAGYQAVKRWTKKVDVFSVDILLVPIHLGVHWCLAVVDFRKKNITYYDSMGGINNEACRILLQYLKQESIDKKRKEFDTNGWQLFSKKSQEIPQQMNGSDCGMFACKYADCITKDRPINFTQQHMPYFRKRMVWEILHRKLL

SEQ ID NO: 113 - DNA, 4948 bp, Homo sapiens
atggagggagcctggtccaggagactgtgtcggacccggtcagccggcccgggctggactgggcggaagcggggagcactgtggggccggcgccttttcctctgccccgccccctgggaccacctcccctcccccctgctgtccggtggccgcgctgtggccgccggtggccgttaggctacctgaggccgttccttctggtctctctctcctgggccgcggagagaccgtctccctgccgttacagcaggccccatcccagcgcccagccgtacttggggaaaggccggttgcgattccggggctttcccgccagagctgggtcttctctggggagagctgttttcaccgggaagctcggctttctgtggtaccggcttcatctcccgccttccttgagacccgagtgatatttcttgactacttctgcgtctcacgtaaacatttctccaactctcctactctgtggtatctccctgagatgtgatatcgctagtgccaccatcagaaagaaacgtctggaccctcctgctcaggactttgtatctttgctaaagtcagtgatgtgaaaagacttgaaatggatgatattgctgataggatgaggatggatgctggagaagtgactttagtgaaccacaactccgtattcaaaacccacctcctgccacaaacaggttttccagaggaccagctttcgctttctgaccagcagattttatcttccaggcaaggacatttggaccgatcttttacatgttccacaagaagtgcagcttataatccaagctattactcagataatccttcctcagacagttttcttggctcaggcgatttaagaacctttggccagagtgcaaatggccaatggagaaattctaccccatcgtcaagctcatctttacaaaaatcaagaaacagccgaagtctttacctcgaaacccgaaagacctcaagtggattatcaaacagttttgcgggaaagtcaaaccatcactgccatgtatctgcatatgaaaaatcttttcctattaaacctgttccaagtccatcttggagtggttcatgtcgtcgaagtcttttgagccccaagaaaactcagaggcgacatgttagtacagcagaagagacagttcaagaagaagaaagagagatttacagacagctgctacagatggtcacagggaaacagtttactatagccaaacccaccacacattttcctttacacctgtctcgatgtcttagttccagtaaaaatactttgaaagactcactgtttaaaaatggaaactcttgtgcatctcagatcattggctctgatacttcatcatctggatctgccagcattttaactaaccaggaacagctgtcccacagtgtatattccctatcttcttataccccagatgttgcatttggatccaaagattctggtactcttcatcatccccatcatcaccactctgttccacatcagccagataacttagcagcttcaaatacacaatctgaaggatcagactctgtgattttactgaaagtgaaagattcccagactccaactcccagttctactttcttccaggcagagctgtggatcaaagaattaactagtgtttatgattctcgagcacgagaaagattgcgccagattgaagaacagaaggcattggccttacagcttcaaaaccagagattgcaggagcgggaacattcagtacatgattcagtagaactacatcttcgtgtacctcttgaaaaggagattcctgttactgttgtccaagaaacacaaaaaaaaggtcataaattaactgatagtgaagatgaatttcctgaaattacagaggaaatggagaaagaaataaagaatgtatttcgtaatgggaatcaggatgaagttctcagtgaagcatttcgcctgaccattacacgcaaagatattcaaactctaaaccatctgaattggctcaatgatgagatcatcaatttctacatgaatatgctgatggagcgaagtaaagagaagggcttgccaagtgtgcatgcatttaatacctttttcttcactaaattaaaaacggctggttatcaggcagtgaaacgttggacaaagaaagtagatgtattttctgttgacattcttttggtgcccattcacctgggagtacactggtgtctagctgttgtggactttagaaagaagaatattacctattacgactccatgggtgggataaacaatgaagcctgcagaatactcttgcaatacctaaagcaagaaagcattgacaagaaaaggaaagagtttgacaccaatggctggcagcttttcagcaagaaaagccaggagattcctcagcagatgaatggaagtgactgtgggatgtttgcctgcaaatatgctgactgtattaccaaagacagaccaatcaacttcacacagcaacacatgccatacttccggaagcggatggtctgggagatcctccaccgaaaactcttgtgaagactgtctcacttagcagaccttgaccatgtgggggaccagctctttgttgtctacagccagagaccttggaaacagctgctcccagccctctgctgttgtaacacccttgatcctggaccaggccctggcgagatgcattcacaagcacatctgcctttccttttgtatctcagatactatttttgcaaagaaactttggtgctgtgaaaggggtgagggacatccctaagctgaagagagagactgcttttcacttcttcagttctgccatcttgttttcaaagggctccagcctcactcagtccctaattatgggactgagaaaagcttggaaagaatcttggtttcatataaattcttgttgttaggccttactaagaagtaggaaagggcatgggcaaaaggtagggataaaaaccaccagcatatacatggacatacacacacacccacacacacaaacacacacacacacacaattttcacgatgtatggtcaggaatgtgactgtaaactggactttggggcccaggcataagtcccttcctccaggacctttcctatttatatgtccctatacaaaatccatctgcttttatacgtagctgttttatcatctgtagcttcatcctatccggaggcacagcacatgagccctggacaggtcccaaagttccaagcagtcctttccgtgaaagcaggggtttgcatgtgctaccaacacatgatacggggaagacccacccagggagcggtttcagtggcgcaacaaagcaccacttttactgttgcctacttctgaccaagaagaaaaaggaccttagtatttagcataaaattccagcgctggatgaatgcagatctagtttggtctgtggctagtttaaatatgtttctaaccacagagaatttcatatatatatacatatatatatacacatacatatatatatatatatatgtatgtataaaatttcacagggatatgcttttttttttaaagactgaatgtgttcaccatttagcctgtagatttatttccattttccaaattccagcacacagagatcccagcccctatgagtagggtgtttgtggactacctaatggaatatttttgaggcctggatgaactttgccatatgggtagaggttacagagggaggtgatattttcagctaaaaaaaaaaacgggtggagtttggactgatcaacttgagatttaaaaactgctattccttttgttctttctagcatctctccccaccctctgagagctcctcaggcttagatagtgaagtgatcaaatgccagtgtcattttgtacttaagttccaaagtaggaacattttatacttttttctgtattgtaataggtagttttgtatgaaatcttttctcctctcccgttgtaccgcattctttccagcattgtgctttttccctgggcttatttgaaaattttactgttttatacaagctcgtttagtacatttttctatgttttaccacaagttacaatttgaaaagaaaactattttttttaaatattccattgttaactgaatgttactgtttccactccagcaactacatgtcctcccttcaactgcctgccttttggggaaagaccaccttttgtgtgtttgttttttctctctctttctttccctttctctttctatctctctttatttttctttctttttctttgtttttgagttttctataggaaataaatagctttctatatatgagttgctggggaccttcacattctcttttagaaagctgtggcatgcagtctcattgcaggactcctggaatattgtctggttcttggtatttactgtatgtaagcaacaacttgaaaggtggcaatatggtgtcgatttggactatgaatcaaaagacctttttcaggttctttcactattgtctgggggactcagaacaagattgttctctgtatttattgtttgtccatttaggtaacatctgtcttaccttcctcacagactttgtacagaccaaagcaacaaatatttattgccatgtatagcagaaaatgaaacatgcaacaaaagcactttgaaaaatatataaggaattgttgagcctgtctgaatttgggccccctttctgactaatgcagttttgcacaaggtagaagttagtgaccctgagaccatcttaccaccctggacctggtccaaatacagacttacacagtggaccattctttcctgagctagccaacaagagcaggagtagtatctggaaactttcccctttgtttaggggtaggctttgatgaccaggaaaaaaaaaaaggtatttctgcattttatggcccaaaggcatgttattaatatcttatgtaatttactttaaactaaataagacttttttctcctgtgtaaaaaaaaa

SEQ ID NO: 114 - protein, 644 aa, Homo sapiens; identical to SEQ ID NO: 112

SEQ ID NO: 115 - DNA, 560 bp, Homo sapiens
gaccagattgggtgcttggccgtccctgccattagcgcgtaacgagagactgcttgctgcggcagagacgccagaggtgcagctccagcagcaatggcagtgacggcgttggcggcgcggacgtggcttggcgtgtggggcgtgaggaccatgcaagcccgaggcttcggctcggatcagtccgagaatgtcgaccggggcgcgggctccatccgggaagccggtggggccttcggaaagagagagcaggctgaagaggaacgatatttccgagcacagagtagagaacaactggcagctttgaaaaaacaccatgaagaagaaatcgttcatcataagaaggagattgagcgtctgcagaaagaaattgagcgccataagcagaagatcaaaatgctaaaacatgatgattaagtgcacaccgtgtgccatagaatggcacatgtcattgcccacttctgtgtagacatggttctggtttaactaatatttgtctgtgtgctactaacagattataataaattgtcatcagtgaactgtgaaaaaaaaaaaaaaaaaaa

SEQ ID NO: 116 - protein, 106 aa, Homo sapiens
MAVTALAARTWLGVWGVRTMQARGFGSDQSENVDRGAGSIREAGGAFGKREQAEEERYFRAQSREQLAALKKHHEEEIVHHKKEIERLQKEIERHKQKIKMLKHDD

SEQ ID NO: 117 - DNA, 636 bp, Homo sapiens
gaccagattgggtgcttggccgtccctgccattagcgcgtaacgagagactgcttgctgcggcagagacgccagaggtgcagctccagcagcaatggcagtgacggcgttggcggcgcggacgtggcttggcgtgtggggcgtgaggaccatgcaagcccgaggcttcggctcggatcagtccgagaatgtcgaccggggcgcgggctccatccgggaagccggtggggccttcggaaagagagagcaggctgaagaggaacgatatttccgacattacaggttatgctttgagatctctttggggtgaaggattgaaattaaaccctgagccaccgtgtccttgtagagcacagagtagagaacaactggcagctttgaaaaaacaccatgaagaagaaatcgttcatcataagaaggagattgagcgtctgcagaaagaaattgagcgccataagcagaagatcaaaatgctaaaacatgatgattaagtgcacaccgtgtgccatagaatggcacatgtcattgcccacttctgtgtagacatggttctggtttaactaatatttgtctgtgtgctactaacagattataataaattgtcatcagtgaactgtgaaaaaaaaaaaaaaaaaaa

SEQ ID NO: 118 - protein, 71 aa, Homo sapiens
MAVTALAARTWLGVWGVRTMQARGFGSDQSENVDRGAGSIREAGGAFGKREQAEEERYFRHYRLCFEISLG

SEQ ID NO: 119 - DNA, 1944 bp, Homo sapiens
gaccagattgggtgcttggccgtccctgccattagcgcgtaacgagagactgcttgctgcggcagagacgccagaggtgcagctccagcagcaatggcagtgacggcgttggcggcgcggacgtggcttggcgtgtggggcgtgaggaccatgcaagcccgaggcttcggctcggatcagtccgagaatgtcgaccggggcgcgggctccatccgggaagccggtggggccttcggaaagagagagcaggctgaagaggaacgatatttccggtgaggctcaccgggtcccaagtccagccctggatctcccaatggccttccaatccttaaactgccaatcgccccacccgttcctacctggtgccttgggcgccccatcccccaacagaactcccgggccccaatccagtataccctaacccttgatgtcccgaccgttgccacgtatagggcactcccagttacctgcacaacagtttcaggcccccaaaccgtttccaccggcgggtctccaaaacaacccacggctcaactcctcctttatcattaccatctcccgcgtggagttctcctcaggtcgtgcgaaacacccccagattcttcgcacagtgtctagatccgaccgcccaacgtttgcctcccagcctgactccctcggcccttacccacctgtcaccccctctacgctctccttcctcgccagcacgccttagctttgcaagcctgcatgcattcaggcttctcaggtgtttctagacccccgactccgcaagagtgaggatgatgggagctggtcatgggagctacttatggttggacaccatcttctaaaggcttttgccctactcagcccaacctagacctgtagatttccctctcctgcttaggagtatggagtgggctgggcctccctttgccagccttgagttatctttaactgacttctgtccactctggagagcagtgaggaattaatcttgcttttgcttgtcctttggcctttcacttctgccttctgttgagaattatcaccatgacacctgccataccgtatagagagccaaggtacagccgttagagactatctaattgagcccctacattttgtagttaaggaaaactgaggcctaaatgtgaccaaaccaacattgtaatccagtcccttcttggaacctaaattgaactgccaagtactgcgcatgcaagagaccctttattggccttacagtgggccattcatttctataggcaaagaaagctctagacagattggaataggaaatggatatttgccttttagctacacccctttgtctgtcttcctcattttgttcctttttttttccctaaaggggagtcaagttccctgggttgttcccctcataaggtattagggacttgtgtcacatctctctggagttttctattttaaagaggaatctgaaagcaataagctctttggtcttcttaagatggctacacctcaatttaagatggggtattctttcactagttgaggagtagaagaggatgaccagctagactcccatggaattggaactcctattccttgcttagacattacaggttatgctttgagatctctttggggtgaaggattgaaattaaaccctgagccaccgtgtccttgtagagcacagagtagagaacaactggcagctttgaaaaaacaccatgaagaagaaatcgttcatcataagaaggagattgagcgtctgcagaaagaaattgagcgccataagcagaagatcaaaatgctaaaacatgatgattaagtgcacaccgtgtgccatagaatggcacatgtcattgcccacttctgtgtagacatggttctggtttaactaatatttgtctgtgtgctactaacagattataataaattgtcatcagtgaactgtgaaaaaaaaaaaaaaaaaaa

SEQ ID NO: 120 - protein, 60 aa, Homo sapiens
MAVTALAARTWLGVWGVRTMQARGFGSDQSENVDRGAGSIREAGGAFGKREQAEEERYFR

SEQ ID NO: 121 - DNA, 2225 bp, Homo sapiens
agtgacgtctttgccccgcgccgcgccgtcccacccatctccctggcctccggtcccaacttcgcttctctgctgaccctctctcgtcgccgctgccgccgccgcagctgccaaaatgtctacaggtccaactgctgccactggcagtaatcgaagacttcagcagacacaaaatcaagtagatgaggtggtggacataatgcgagttaacgtggacaaggttctggaaagagaccagaagctctctgagttagacgaccgtgcagacgcactgcaggcaggcgcttctcaatttgaaacgagcgcagccaagttgaagaggaaatattggtggaagaattgcaagatgtgggcaatcgggattactgttctggttatcttcatcatcatcatcatcgtgtgggttgtctcttcatgaagaaccagcggaactcaaaactgctgttcaagaaacctcttcaagacttttgacttagaacctgctatattatcaagcttacctactgttatctctaaaattttttttgtgttaatgtaaagttgaatttctaggaaacgtgcctttgttttttaatatgcactccaaattagaaggccggccccgtccacattttgcacagtgcctttacagatttacgtatgggctgatgaagaggccttcttaagttccagagtgctataatctagatgtaatgttgtcactaattaattgccattactcccagttagttacccttgtcatttggcattattttcagaaccacattttaaacctttgggtaatcagatttccaacttatgccttccagaaaaaaacactactgcctaacacaaatctgtgataacaacaggctgtgccttattttgataattttctgattccctagaagagaaccctctactttttgtaagcactactgactctcgctgtatttaagatgctggtgaagagcttttgctcttgcattagatttgaagatgtttacattgttgttattgttatgtatcacttgctaaaaatattgttttaatcagagataacctctttaaaaaaatttttaaagaactatggctatgaccaaagcttctattttgccaaaaagttaaataccgataaaatggccttaagtgtattcctgacagttaaattcagaaacgtgccaaatggaactcaaggtgccccttcagaattaaaatcattaccttgtgtgtgaaccttctacatcttcataggcctttcttccttttgaaaggctgtagacagtgtggctccccttctgattcagtattttgcatgggggttagagaaggtttgaggtagactctgaccgtctcataaaagagttctacccagcagttggcagattatcagctgtggactccagcatgtttctgataattatgcaagcaacaattctgtagcctcaagtaagaccacctgtgaacttgatcattatctggcccaaatatgaagataaactataactttggagtttgtttcctatttgtattcacattctgcttcctaaatcagttttctaaattatgcctgcaattaggcattggtcaggggtgaatggctcttttcacagagagtagccaaccagagacctttgctttgatatcatcaactgcagagaatgctgttgatgggaatgctggaagcagaaactttgtcatcggaaaaacttttcttgtatgcatgagactcaacatcaggatccacagcttaaagatgggaattcaggtatgaaagaaaacaggcaaggaggcactgagggagaaagacacagactttatcgctctgtggctcattgttactggaatattctaaaactcttgttcacatgctattatgacttataaagcagcaacagctgaggcgcaccaggacacagcttccatttctttaacgtctgttcccttaacatcgctgaaatgatttactgttgaagagatgccttgcggtgtggccagctgtgaggagaaagcagctggcagtgttaggacattagtccaccttcagcgcagggtctctggccgggtctgactcagaaaccttggtactcgccccttggccacagtgcccagacccatgtaacccactggctcctgcattaacccagaaatacctcgcttctatctgtgcacttagctgggaacttacccactgtaatcacctaaataaagtgtttataaacatgaaaaaaaaaaaaaaaaaaaaa

SEQ ID NO: 122 - protein, 100 aa, Homo sapiens
MSTGPTAATGSNRRLQQTQNQVDEVVDIMRVNVDKVLERDQKLSELDDRADALQAGASQFETSAAKLKRKYWWKNCKMWAIGITVLVIFIIIIIVWVVSS

SEQ ID NO: 123 - DNA, 6994 bp, Homo sapiens
agaagctcccggccgggggcgcgcacgtaggcacgcagaggccgtcacgtgggtcgccgaggctcgcaagtgcgcgtggccgtggcggctggtgtggggttgagtcagttgtgggacccggagctgctgacccagcgggtggcccaccgaaccggtgacacagcggcaggcgttagggctcgggagccgcgagcctggcctcgtcctagagctcggccgagccgtcgccgccgtcgtcccccgcccccagtcagcaaaccgccgccgcgggcgcgcccccgctctgcgctgtctctccgatggcgtccgcctcaggggccatggcgaagcacgagcagatcctggtcctcgatccgcccacagacctcaaattcaaaggccccttcacagatgtagtcactacaaatcttaaattgcgaaatccatcggatagaaaagtgtgtttcaaagtgaagactacagcacctcgccggtactgtgtgaggcccaacagtggaattattgacccagggtcaactgtgactgtttcagtaatgctacagccctttgactatgatccgaatgaaaagagtaaacacaagtttatggtacagacaatttttgctccaccaaacacttcagatatggaagctgtgtggaaagaggcaaaacctgatgaattaatggattccaaattgagatgcgtatttgaaatgcccaatgaaaatgataaattgggtataactccaccagggaatgctccgactgtcacttcaatgagcagcatcaacaacacagttgcaacacctgccagttatcacacgaaggatgaccccaggggactcagtgtgttgaaacaggagaaacagaagaatgatatggaacctagcaaagctgttccactgaatgcatctaagcaagatggacctatgccaaaaccacacagtgtttcacttaatgataccgaaacaaggaaactaatggaagagtgtaaaagacttcagggagaaatgatgaagctatcagaagaaaatcggcacctgagagatgaaggtttaaggctcagaaaggtagcacattcggataaacctggatcaacctcaactgcatccttcagagataatgtcaccagtcctcttccttcacttcttgttgtaattgcagccattttcattggattctttctagggaaattcatcttgtagagtgaagcatgcagagtgctgtttctttttttttttttctcttgaccagaaaaagatttgtttacctaccatttcattggtagtatggcccacggtgaccatttttttgtgtgtacagcgtcatataggctttgcctttaatgatctcttacggttagaaaacacaataaaaacaaactgttcggctactggacaggttgtatattaccagatcatcactagcagatgtcagttgcacattgagtcctttatgaaattcataaataaagaattgttctttctttgtggttttaataagagttcaagaattgttcagagtcttgtaaatgttattttaataatccctttaaattttatctgttgctgttacctcttgaaatatgatttatttagattgctaatcccactcattcaggaaatgccaagaggtattccttggggaaatggtgcctcttacagtgtaaatttttcctcctttacctttgctaatatcatggcagaatttttcttatcccttgtgaggcagttgttgactgagtttttcatccttacaatcctgtcccatggtatttaacataaaaaaaaataaaactgttaacagattcttgctcgatagcttgtttgtgtctgtcgtgttattagagggaactccactatatatggtcacttgaaattatgatgcaaaggtttctcttgcattgaaaccctcttggatattacagtatttttaattgaaagtcctaattctgttaaggaaaggagttgattaaattttaaggtaccactggtattttgggagattataatcagtttgttttcaagataatagaaaataaggtccatgagaatagaagttatgtgatttcagtgagttgatgtgtacagcatggctgtgctccatctgatttaccccattcttaagttctgagagtatgttctcaaggaagatttaactctctttggttttaaattactttttaaccagcctaataaataagtcttactacttttcataatatttcataatagttaaaagtaggtgtttttttcgtgctcaatttggcactcaaaataatgttcattatggaagtttggtaatactgagcaagcctgtggaattttctttatgaaaaatgattttagcctttgcaaatgttaaccatgtgaaacacattttcagtataagtatgcgttacagggtttgatactttcctgcacttaggtttgtcctattcttcatttattcatactaggatagaaaattttggaatcagaaaatagatccagtgtttagctacatacaatctagtacaagtgaatttttattcttaaacataggtgtgttggctctttttttaaaagatgcgctctacctgaaaaggaaattggattttagaactggatgtggtgcagtgaagtattttaggcccaggtctgtgtacacattttatagaagaatgaagtactctgaagtattttggttgccttttcatttcaactgtgttttgaatttgtcagatcacacatatattgtgttattgggcgctgtggtatcttttataaaacctcttgcttgtgtgcaaaagttcctaaaaggaaacacaagtaatgcctatccattactagcatgctatgctgcatgctttactgccattgctgtatgctttactgtctttgtaaaaatccccctctccccttttctggtaactggaaaagcatgctaaaaatagtcttatattttcaccccataaatgcagaatcagtaattccttggcttaaagctcttatataatcaatattattggtggtaaataccaagtttggtatctcatagctatctttttttaaagaaattaagttcttgaaaatttagccaaatcccgttttatgggaatgctctttagaattcattttgttcagcccctttgttctatggttgagaaatctgaggccttacgaaggttaagagaactttccccgtgtctcacaggtaggtagaggcagagctggaactagatatctggtctgttgactctagctcagtgtcttctggtaactgttgaaaattgtcttagtttgagagatggctgaaataatgaacataaaatgctatttataataacaagtatatgtgaaatttcttattgtaagactactaccggcttactgttgaatagtttggttatagtgtttaggctagaaatgcctcccacattggtaataaacattacaaaatacaatgtatttttaggtaggcattttataaaatgcattatgccatggttgcttttgagatagattgtagtctgggtagcatctttaaaatgtatgtgggcttaactgttgttcatatcaggagatgctctgattgtataggtgagactctgtttctgttatttttaattgctgtatgaaatgtgatcagattattttactaccaacagttatagtttgaaagtccaactgtattaattgactgataatatgataatatagagattaaattgtttgtcttcattccttatatgtttagaagtttttgctttgtctgcctgcttacttgtatatgtaagcatgagggaaatacactgttgctaatactgaaattacaatcaagtaactaaggccttgagttcatatgtgacactgaatgcactagcttccttcgttctataactaatgtaccttaacttcccccattcttatatttacaagaagctaagtcattatgttctgagtgtgtggtatgttcccttaaaaaaaaatgacacttggaagaaaaatgtatgaaattcagaaattccgatcaaagaaaagtaattctttctttttttttttgagacagagtcttgctttgttgcccaggctggagggcagtggtgtgatctcacctcactgcagcttccgcctcctgggttcaagtgattctcatggctcagccgcctgagtagctgggattacaggtgtgagccaacaagcccggctaatttttgtatttttagtagagacaaggtttcaccatgttggtcaggctgggctcaaactcctgaatccgcctgcctcggcctcccaaagtgctgggattacaggtgtgagctgccgcacccagccaagaaaaataatactcttaaatacttagatgttcacctaaagttgatattatttggtatgggaattacttttgaactgtaatctttcagattacaccactttgaaaacaagttttaacagtagggtaaaaatatagtttttgagggtattcccaacttgtgatcttctaccactttagagacattcaagtaatagttttcttagagctttgcacattcctattcactgagattttaaaaatttcacctttattcgagggaaggatcaatgcttattaccatttggaaaaacgaagatcagaaggtaaatgatctttattttctagctttaaagggaaattaaaccattcatgaataaactttaaaaatgtgaagtgtccttttccttttcacaatacaaaaaaaatttcaacagattgtgtggtttgtgcatttatatcctgttaagcattaatagctaatcactgggacttgaattctgatggcagatagtctcttgcttagtgagatggagttaactattttttagtaggaagtgagaacagctgattttcatgccacgtttcatagccccacttttggtagactaccaccacgcttcttcgcgtaagcagtggcatcttgggaatgaatgcccagccgctcgtgggttggtgcaaagaagtataaacatatatcactaaggaaaaagaaagtttgtcttgcccttctgacacagtgtgtgcacttcaggcaatttttggaaaatataaaaaattccaaattctgcctttcagcagcatcaattgctaggaacatttcattcatttccctgtaatattaatgttctttaagcataatcactaattataagttgtatcctatttttttccagcttaatttctgtggtttattgaaaaccaagtataaatgtgactaaaagcattttgctttgtttttatagttaactttcttaaggttatggacattttataatgtaacatttgattggcctggcctcttgacaattcccttctagttatgcatatcctcctgttgccacatttcttgttttaaaactcagtttcttgttttccagttgttgctatgtataacacccatcttgaaagagagtatataggaagttattcagataacttttgtagtagtgatattcaactatagcagtaccttaactcatgatgagcttaggaacataaaagataattgttgcttgaatagcacccccagagatactgacctaattggtctggggtggagatctggcatggtagtttttttcaagctccaatcatcggccagacagttgctttatgtaggtttttaaatgccaaaggcagatatgaagtagatttaattaagacttgacttcagcaatacaggggaacttaaaatacttatttttctttaaactgcaggagtcactgttaggtattgcttaaaaaaaattgcataaaagctttgcttgtcaagttaggattgctggaataccactaaagatttttgacttgtgaataaatgagctgtcatcgcaaaaaggcgatttgagaaatgtgggcttcagtattaattgccattttgctgacacccagtgtacctacctacctgagaaatttattttgtccatcatgtatttctcaaagcaaaaggtggttttcaagtataatgtcgttttcaacatgcttattacttagttttacgtcagctcatttcatcatcattgataacttgtgaaatacttatctccatcctatggaataggggagacgggtttagacaggttcaattagctcaagtctacacagctgaagtagcagagaaagtgggatctagatggtctgatcctagtgatctaccatatgaaggacatagtttgtgtcctggtccaagtcaaatattgactcctcacaaacagtaagtatggcaattttgtgatgcctttgattccactttacatggagtactattatttgtgaaatgtctttaagatttttggtcttaaatttttgaagactgctttccccctttatctcccagaaaattgagaagaagtaaactcctgcccactaacaatctcagtccgtgaacaaaaccaacatgaacattcctaaacaagagtgtgtgttactctaagaagaaggctatagaatttatggaaatggcttatgtaacctacaagactggagaacagaatgtgactggccttttctaatggtcctttaagatttaatgattaaagcaagagttttttataattgactttgtggtctaaattcttgatactgtttataattctacaaagaacaaaaattgttatgtactataggcacttaagaaccctgaggaaaaataatacaatgtgtgtgtgtgagagagagagtgagttactgacattgttccaaaaaaaaaaaaaaaaaaaaaaaaaatgtggagggttgaaatggtaaggaattggaatcttttgtattttcgagcaataagaattcctattcttgtttcaaatagaggtttgttaggaattacagttgtggggagcaaactttcttttttgtgctgttttaattcaaaatgtatatccttaattgtatataatatgtagataaatatatgagggtattaagctactttgaattaaatttaaggatatatttcacatgaaaacaaatacaaacgagaatcaaaataaagttttgcaaagta

SEQ ID NO: 124 - protein, 294 aa, Homo sapiens
MASASGAMAKHEQILVLDPPTDLKFKGPFTDVVTTNLKLRNPSDRKVCFKVKTTAPRRYCVRPNSGIIDPGSTVTVSVMLQPFDYDPNEKSKHKFMVQTIFAPPNTSDMEAVWKEAKPDELMDSKLRCVFEMPNENDKLGITPPGNAPTVTSMSSINNTVATPASYHTKDDPRGLSVLKQEKQKNDMEPSKAVPLNASKQDGPMPKPHSVSLNDTETRKLMEECKRLQGEMMKLSEENRHLRDEGLRLRKVAHSDKPGSTSTASFRDNVTSPLPSLLVVIAAIFIGFFLGKFIL

SEQ ID NO: 125 - DNA, 6859 bp, Homo sapiens
agaagctcccggccgggggcgcgcacgtaggcacgcagaggccgtcacgtgggtcgccgaggctcgcaagtgcgcgtggccgtggcggctggtgtggggttgagtcagttgtgggacccggagctgctgacccagcgggtggcccaccgaaccggtgacacagcggcaggcgttagggctcgggagccgcgagcctggcctcgtcctagagctcggccgagccgtcgccgccgtcgtcccccgcccccagtcagcaaaccgccgccgcgggcgcgcccccgctctgcgctgtctctccgatggcgtccgcctcaggggccatggcgaagcacgagcagatcctggtcctcgatccgcccacagacctcaaattcaaaggccccttcacagatgtagtcactacaaatcttaaattgcgaaatccatcggatagaaaagtgtgtttcaaagtgaagactacagcacctcgccggtactgtgtgaggcccaacagtggaattattgacccagggtcaactgtgactgtttcagtaatgctacagccctttgactatgatccgaatgaaaagagtaaacacaagtttatggtacagacaatttttgctccaccaaacacttcagatatggaagctgtgtggaaagaggcaaaacctgatgaattaatggattccaaattgagatgcgtatttgaaatgcccaatgaaaatgataaattgaatgatatggaacctagcaaagctgttccactgaatgcatctaagcaagatggacctatgccaaaaccacacagtgtttcacttaatgataccgaaacaaggaaactaatggaagagtgtaaaagacttcagggagaaatgatgaagctatcagaagaaaatcggcacctgagagatgaaggtttaaggctcagaaaggtagcacattcggataaacctggatcaacctcaactgcatccttcagagataatgtcaccagtcctcttccttcacttcttgttgtaattgcagccattttcattggattctttctagggaaattcatcttgtagagtgaagcatgcagagtgctgtttctttttttttttttctcttgaccagaaaaagatttgtttacctaccatttcattggtagtatggcccacggtgaccatttttttgtgtgtacagcgtcatataggctttgcctttaatgatctcttacggttagaaaacacaataaaaacaaactgttcggctactggacaggttgtatattaccagatcatcactagcagatgtcagttgcacattgagtcctttatgaaattcataaataaagaattgttctttctttgtggttttaataagagttcaagaattgttcagagtcttgtaaatgttattttaataatccctttaaattttatctgttgctgttacctcttgaaatatgatttatttagattgctaatcccactcattcaggaaatgccaagaggtattccttggggaaatggtgcctcttacagtgtaaatttttcctcctttacctttgctaatatcatggcagaatttttcttatcccttgtgaggcagttgttgactgagtttttcatccttacaatcctgtcccatggtatttaacataaaaaaaaataaaactgttaacagattcttgctcgatagcttgtttgtgtctgtcgtgttattagagggaactccactatatatggtcacttgaaattatgatgcaaaggtttctcttgcattgaaaccctcttggatattacagtatttttaattgaaagtcctaattctgttaaggaaaggagttgattaaattttaaggtaccactggtattttgggagattataatcagtttgttttcaagataatagaaaataaggtccatgagaatagaagttatgtgatttcagtgagttgatgtgtacagcatggctgtgctccatctgatttaccccattcttaagttctgagagtatgttctcaaggaagatttaactctctttggttttaaattactttttaaccagcctaataaataagtcttactacttttcataatatttcataatagttaaaagtaggtgtttttttcgtgctcaatttggcactcaaaataatgttcattatggaagtttggtaatactgagcaagcctgtggaattttctttatgaaaaatgattttagcctttgcaaatgttaaccatgtgaaacacattttcagtataagtatgcgttacagggtttgatactttcctgcacttaggtttgtcctattcttcatttattcatactaggatagaaaattttggaatcagaaaatagatccagtgtttagctacatacaatctagtacaagtgaatttttattcttaaacataggtgtgttggctctttttttaaaagatgcgctctacctgaaaaggaaattggattttagaactggatgtggtgcagtgaagtattttaggcccaggtctgtgtacacattttatagaagaatgaagtactctgaagtattttggttgccttttcatttcaactgtgttttgaatttgtcagatcacacatatattgtgttattgggcgctgtggtatcttttataaaacctcttgcttgtgtgcaaaagttcctaaaaggaaacacaagtaatgcctatccattactagcatgctatgctgcatgctttactgccattgctgtatgctttactgtctttgtaaaaatccccctctccccttttctggtaactggaaaagcatgctaaaaatagtcttatattttcaccccataaatgcagaatcagtaattccttggcttaaagctcttatataatcaatattattggtggtaaataccaagtttggtatctcatagctatctttttttaaagaaattaagttcttgaaaatttagccaaatcccgttttatgggaatgctctttagaattcattttgttcagcccctttgttctatggttgagaaatctgaggccttacgaaggttaagagaactttccccgtgtctcacaggtaggtagaggcagagctggaactagatatctggtctgttgactctagctcagtgtcttctggtaactgttgaaaattgtcttagtttgagagatggctgaaataatgaacataaaatgctatttataataacaagtatatgtgaaatttcttattgtaagactactaccggcttactgttgaatagtttggttatagtgtttaggctagaaatgcctcccacattggtaataaacattacaaaatacaatgtatttttaggtaggcattttataaaatgcattatgccatggttgcttttgagatagattgtagtctgggtagcatctttaaaatgtatgtgggcttaactgttgttcatatcaggagatgctctgattgtataggtgagactctgtttctgttatttttaattgctgtatgaaatgtgatcagattattttactaccaacagttatagtttgaaagtccaactgtattaattgactgataatatgataatatagagattaaattgtttgtcttcattccttatatgtttagaagtttttgctttgtctgcctgcttacttgtatatgtaagcatgagggaaatacactgttgctaatactgaaattacaatcaagtaactaaggccttgagttcatatgtgacactgaatgcactagcttccttcgttctataactaatgtaccttaacttcccccattcttatatttacaagaagctaagtcattatgttctgagtgtgtggtatgttcccttaaaaaaaaatgacacttggaagaaaaatgtatgaaattcagaaattccgatcaaagaaaagtaattctttctttttttttttgagacagagtcttgctttgttgcccaggctggagggcagtggtgtgatctcacctcactgcagcttccgcctcctgggttcaagtgattctcatggctcagccgcctgagtagctgggattacaggtgtgagccaacaagcccggctaatttttgtatttttagtagagacaaggtttcaccatgttggtcaggctgggctcaaactcctgaatccgcctgcctcggcctcccaaagtgctgggattacaggtgtgagctgccgcacccagccaagaaaaataatactcttaaatacttagatgttcacctaaagttgatattatttggtatgggaattacttttgaactgtaatctttcagattacaccactttgaaaacaagttttaacagtagggtaaaaatatagtttttgagggtattcccaacttgtgatcttctaccactttagagacattcaagtaatagttttcttagagctttgcacattcctattcactgagattttaaaaatttcacctttattcgagggaaggatcaatgcttattaccatttggaaaaacgaagatcagaaggtaaatgatctttattttctagctttaaagggaaattaaaccattcatgaataaactttaaaaatgtgaagtgtccttttccttttcacaatacaaaaaaaatttcaacagattgtgtggtttgtgcatttatatcctgttaagcattaatagctaatcactgggacttgaattctgatggcagatagtctcttgcttagtgagatggagttaactattttttagtaggaagtgagaacagctgattttcatgccacgtttcatagccccacttttggtagactaccaccacgcttcttcgcgtaagcagtggcatcttgggaatgaatgcccagccgctcgtgggttggtgcaaagaagtataaacatatatcactaaggaaaaagaaagtttgtcttgcccttctgacacagtgtgtgcacttcaggcaatttttggaaaatataaaaaattccaaattctgcctttcagcagcatcaattgctaggaacatttcattcatttccctgtaatattaatgttctttaagcataatcactaattataagttgtatcctatttttttccagcttaatttctgtggtttattgaaaaccaagtataaatgtgactaaaagcattttgctttgtttttatagttaactttcttaaggttatggacattttataatgtaacatttgattggcctggcctcttgacaattcccttctagttatgcatatcctcctgttgccacatttcttgttttaaaactcagtttcttgttttccagttgttgctatgtataacacccatcttgaaagagagtatataggaagttattcagataacttttgtagtagtgatattcaactatagcagtaccttaactcatgatgagcttaggaacataaaagataattgttgcttgaatagcacccccagagatactgacctaattggtctggggtggagatctggcatggtagtttttttcaagctccaatcatcggccagacagttgctttatgtaggtttttaaatgccaaaggcagatatgaagtagatttaattaagacttgacttcagcaatacaggggaacttaaaatacttatttttctttaaactgcaggagtcactgttaggtattgcttaaaaaaaattgcataaaagctttgcttgtcaagttaggattgctggaataccactaaagatttttgacttgtgaataaatgagctgtcatcgcaaaaaggcgatttgagaaatgtgggcttcagtattaattgccattttgctgacacccagtgtacctacctacctgagaaatttattttgtccatcatgtatttctcaaagcaaaaggtggttttcaagtataatgtcgttttcaacatgcttattacttagttttacgtcagctcatttcatcatcattgataacttgtgaaatacttatctccatcctatggaataggggagacgggtttagacaggttcaattagctcaagtctacacagctgaagtagcagagaaagtgggatctagatggtctgatcctagtgatctaccatatgaaggacatagtttgtgtcctggtccaagtcaaatattgactcctcacaaacagtaagtatggcaattttgtgatgcctttgattccactttacatggagtactattatttgtgaaatgtctttaagatttttggtcttaaatttttgaagactgctttccccctttatctcccagaaaattgagaagaagtaaactcctgcccactaacaatctcagtccgtgaacaaaaccaacatgaacattcctaaacaagagtgtgtgttactctaagaagaaggctatagaatttatggaaatggcttatgtaacctacaagactggagaacagaatgtgactggccttttctaatggtcctttaagatttaatgattaaagcaagagttttttataattgactttgtggtctaaattcttgatactgtttataattctacaaagaacaaaaattgttatgtactataggcacttaagaaccctgaggaaaaataatacaatgtgtgtgtgtgagagagagagtgagttactgacattgttccaaaaaaaaaaaaaaaaaaaaaaaaaatgtggagggttgaaatggtaaggaattggaatcttttgtattttcgagcaataagaattcctattcttgtttcaaatagaggtttgttaggaattacagttgtggggagcaaactttcttttttgtgctgttttaattcaaaatgtatatccttaattgtatataatatgtagataaatatatgagggtattaagctactttgaattaaatttaaggatatatttcacatgaaaacaaatacaaacgagaatcaaaataaagttttgcaaagta

SEQ ID NO: 126 - protein, 249 aa, Homo sapiens
MASASGAMAKHEQILVLDPPTDLKFKGPFTDVVTTNLKLRNPSDRKVCFKVKTTAPRRYCVRPNSGIIDPGSTVTVSVMLQPFDYDPNEKSKHKFMVQTIFAPPNTSDMEAVWKEAKPDELMDSKLRCVFEMPNENDKLNDMEPSKAVPLNASKQDGPMPKPHSVSLNDTETRKLMEECKRLQGEMMKLSEENRHLRDEGLRLRKVAHSDKPGSTSTASFRDNVTSPLPSLLVVIAAIFIGFFLGKFIL

SEQ ID NO: 127 - DNA, 2257 bp, Homo sapiens
cttccgtcggccattttaggtggtccgcggcggcgccattaaagcgaggaggaggcgagagcggccgccgctggtgcttattcttttttagtgcagcgggagagagcgggagtgtgcgccgcgcgagagtgggaggcgaagggggcaggccagggagaggcgcaggagcctttgcagccacgcgcgcgccttccctgtcttgtgtgcttcgcgaggtagagcgggcgcgcggcagcggcggggattactttgctgctagtttcggttcgcggcagcggcgggtgtagtctcggcggcagcggcggagacactagcactatgtcggaggagcagttcggcggggacggggcggcggcagcggcaacggcggcggtaggcggctcggcgggcgagcaggagggagccatggtggcggcgacacagggggcagcggcggcggcgggaagcggagccgggaccgggggcggaaccgcgtctggaggcaccgaagggggcagcgccgagtcggagggggcgaagattgacgccagtaagaacgaggaggatgaaggccattcaaactcctccccacgacactctgaagcagcgacggcacagcgggaagaatggaaaatgtttataggaggccttagctgggacactacaaagaaagatctgaaggactacttttccaaatttggtgaagttgtagactgcactctgaagttagatcctatcacagggcgatcaaggggttttggctttgtgctatttaaagaatcggagagtgtagataaggtcatggatcaaaaagaacataaattgaatgggaaggtgattgatcctaaaagggccaaagccatgaaaacaaaagagccggttaaaaaaatttttgttggtggcctttctccagatacacctgaagagaaaataagggagtactttggtggttttggtgaggtggaatccatagagctccccatggacaacaagaccaataagaggcgtgggttctgctttattacctttaaggaagaagaaccagtgaagaagataatggaaaagaaataccacaatgttggtcttagtaaatgtgaaataaaagtagccatgtcgaaggaacaatatcagcaacagcaacagtggggatctagaggaggatttgcaggaagagctcgtggaagaggtggtggccccagtcaaaactggaaccagggatatagtaactattggaatcaaggctatggcaactatggatataacagccaaggttacggtggttatggaggatatgactacactggttacaacaactactatggatatggtgattatagcaaccagcagagtggttatgggaaggtatccaggcgaggtggtcatcaaaatagctacaaaccatactaaattattccatttgcaacttatccccaacaggtggtgaagcagtattttccaatttgaagattcatttgaaggtggctcctgccacctgctaatagcagttcaaactaaattttttgtatcaagtccctgaatggaagtatgacgttgggtccctctgaagtttaattctgagttctcattaaaagaaatttgctttcattgttttatttcttaattgctatgcttcagaatcaatttgtgttttatgccctttcccccagtattgtagagcaagtcttgtgttaaaagcccagtgtgacagtgtcatgatgtagtagtgtcttactggttttttaataaatccttttgtataaaaatgtattggctcttttatcatcagaataggaaaaattgtcatggattcaagttattaaaagcataagtttggaagacaggcttgccgaaattgaggacatgattaaaattgcagtgaagtttgaaatgtttttagcaaaatctaatttttgccataatgtgtcctccctgtccaaattgggaatgacttaatgtcaatttgtttgttggttgttttaataatacttccttatgtagccattaagatttatatgaatattttcccaaatgcccagtttttgcttaatatgtattgtgctttttagaacaaatctggataaatgtgcaaaagtacccctttgcacagatagttaatgttttatgcttccattaaataaaaaggacttaaaatctgttaattataatagaaatgcggctagttcagagagatttttagagctgtggtggacttcatagatgaattcaagtgttgagggaggattaaagaaatatataccgtgtttatgtgtgtgtgctt

SEQ ID NO: 128 - protein, 355 aa, Homo sapiens
MSEEQFGGDGAAAAATAAVGGSAGEQEGAMVAATQGAAAAAGSGAGTGGGTASGGTEGGSAESEGAKIDASKNEEDEGHSNSSPRHSEAATAQREEWKMFIGGLSWDTTKKDLKDYFSKFGEVVDCTLKLDPITGRSRGFGFVLFKESESVDKVMDQKEHKLNGKVIDPKRAKAMKTKEPVKKIFVGGLSPDTPEEKIREYFGGFGEVESIELPMDNKTNKRRGFCFITFKEEEPVKKIMEKKYHNVGLSKCEIKVAMSKEQYQQQQQWGSRGGFAGRARGRGGGPSQNWNQGYSNYWNQGYGNYGYNSQGYGGYGGYDYTGYNNYYGYGDYSNQQSGYGKVSRRGGHQNSYKPY

SEQ ID NO: 129 - DNA, 2200 bp, Homo sapiens
cttccgtcggccattttaggtggtccgcggcggcgccattaaagcgaggaggaggcgagagcggccgccgctggtgcttattcttttttagtgcagcgggagagagcgggagtgtgcgccgcgcgagagtgggaggcgaagggggcaggccagggagaggcgcaggagcctttgcagccacgcgcgcgccttccctgtcttgtgtgcttcgcgaggtagagcgggcgcgcggcagcggcggggattactttgctgctagtttcggttcgcggcagcggcgggtgtagtctcggcggcagcggcggagacactagcactatgtcggaggagcagttcggcggggacggggcggcggcagcggcaacggcggcggtaggcggctcggcgggcgagcaggagggagccatggtggcggcgacacagggggcagcggcggcggcgggaagcggagccgggaccgggggcggaaccgcgtctggaggcaccgaagggggcagcgccgagtcggagggggcgaagattgacgccagtaagaacgaggaggatgaagggaaaatgtttataggaggccttagctgggacactacaaagaaagatctgaaggactacttttccaaatttggtgaagttgtagactgcactctgaagttagatcctatcacagggcgatcaaggggttttggctttgtgctatttaaagaatcggagagtgtagataaggtcatggatcaaaaagaacataaattgaatgggaaggtgattgatcctaaaagggccaaagccatgaaaacaaaagagccggttaaaaaaatttttgttggtggcctttctccagatacacctgaagagaaaataagggagtactttggtggttttggtgaggtggaatccatagagctccccatggacaacaagaccaataagaggcgtgggttctgctttattacctttaaggaagaagaaccagtgaagaagataatggaaaagaaataccacaatgttggtcttagtaaatgtgaaataaaagtagccatgtcgaaggaacaatatcagcaacagcaacagtggggatctagaggaggatttgcaggaagagctcgtggaagaggtggtggccccagtcaaaactggaaccagggatatagtaactattggaatcaaggctatggcaactatggatataacagccaaggttacggtggttatggaggatatgactacactggttacaacaactactatggatatggtgattatagcaaccagcagagtggttatgggaaggtatccaggcgaggtggtcatcaaaatagctacaaaccatactaaattattccatttgcaacttatccccaacaggtggtgaagcagtattttccaatttgaagattcatttgaaggtggctcctgccacctgctaatagcagttcaaactaaattttttgtatcaagtccctgaatggaagtatgacgttgggtccctctgaagtttaattctgagttctcattaaaagaaatttgctttcattgttttatttcttaattgctatgcttcagaatcaatttgtgttttatgccctttcccccagtattgtagagcaagtcttgtgttaaaagcccagtgtgacagtgtcatgatgtagtagtgtcttactggttttttaataaatccttttgtataaaaatgtattggctcttttatcatcagaataggaaaaattgtcatggattcaagttattaaaagcataagtttggaagacaggcttgccgaaattgaggacatgattaaaattgcagtgaagtttgaaatgtttttagcaaaatctaatttttgccataatgtgtcctccctgtccaaattgggaatgacttaatgtcaatttgtttgttggttgttttaataatacttccttatgtagccattaagatttatatgaatattttcccaaatgcccagtttttgcttaatatgtattgtgctttttagaacaaatctggataaatgtgcaaaagtacccctttgcacagatagttaatgttttatgcttccattaaataaaaaggacttaaaatctgttaattataatagaaatgcggctagttcagagagatttttagagctgtggtggacttcatagatgaattcaagtgttgagggaggattaaagaaatatataccgtgtttatgtgtgtgtgctt

SEQ ID NO: 130 - protein, 336 aa, Homo sapiens
MSEEQFGGDGAAAAATAAVGGSAGEQEGAMVAATQGAAAAAGSGAGTGGGTASGGTEGGSAESEGAKIDASKNEEDEGKMFIGGLSWDTTKKDLKDYFSKFGEVVDCTLKLDPITGRSRGFGFVLFKESESVDKVMDQKEHKLNGKVIDPKRAKAMKTKEPVKKIFVGGLSPDTPEEKIREYFGGFGEVESIELPMDNKTNKRRGFCFITFKEEEPVKKIMEKKYHNVGLSKCEIKVAMSKEQYQQQQQWGSRGGFAGRARGRGGGPSQNWNQGYSNYWNQGYGNYGYNSQGYGGYGGYDYTGYNNYYGYGDYSNQQSGYGKVSRRGGHQNSYKPY

SEQ ID NO: 131 - DNA, 2110 bp, Homo sapiens
cttccgtcggccattttaggtggtccgcggcggcgccattaaagcgaggaggaggcgagagcggccgccgctggtgcttattcttttttagtgcagcgggagagagcgggagtgtgcgccgcgcgagagtgggaggcgaagggggcaggccagggagaggcgcaggagcctttgcagccacgcgcgcgccttccctgtcttgtgtgcttcgcgaggtagagcgggcgcgcggcagcggcggggattactttgctgctagtttcggttcgcggcagcggcgggtgtagtctcggcggcagcggcggagacactagcactatgtcggaggagcagttcggcggggacggggcggcggcagcggcaacggcggcggtaggcggctcggcgggcgagcaggagggagccatggtggcggcgacacagggggcagcggcggcggcgggaagcggagccgggaccgggggcggaaccgcgtctggaggcaccgaagggggcagcgccgagtcggagggggcgaagattgacgccagtaagaacgaggaggatgaaggccattcaaactcctccccacgacactctgaagcagcgacggcacagcgggaagaatggaaaatgtttataggaggccttagctgggacactacaaagaaagatctgaaggactacttttccaaatttggtgaagttgtagactgcactctgaagttagatcctatcacagggcgatcaaggggttttggctttgtgctatttaaagaatcggagagtgtagataaggtcatggatcaaaaagaacataaattgaatgggaaggtgattgatcctaaaagggccaaagccatgaaaacaaaagagccggttaaaaaaatttttgttggtggcctttctccagatacacctgaagagaaaataagggagtactttggtggttttggtgaggtggaatccatagagctccccatggacaacaagaccaataagaggcgtgggttctgctttattacctttaaggaagaagaaccagtgaagaagataatggaaaagaaataccacaatgttggtcttagtaaatgtgaaataaaagtagccatgtcgaaggaacaatatcagcaacagcaacagtggggatctagaggaggatttgcaggaagagctcgtggaagaggtggtgaccagcagagtggttatgggaaggtatccaggcgaggtggtcatcaaaatagctacaaaccatactaaattattccatttgcaacttatccccaacaggtggtgaagcagtattttccaatttgaagattcatttgaaggtggctcctgccacctgctaatagcagttcaaactaaattttttgtatcaagtccctgaatggaagtatgacgttgggtccctctgaagtttaattctgagttctcattaaaagaaatttgctttcattgttttatttcttaattgctatgcttcagaatcaatttgtgttttatgccctttcccccagtattgtagagcaagtcttgtgttaaaagcccagtgtgacagtgtcatgatgtagtagtgtcttactggttttttaataaatccttttgtataaaaatgtattggctcttttatcatcagaataggaaaaattgtcatggattcaagttattaaaagcataagtttggaagacaggcttgccgaaattgaggacatgattaaaattgcagtgaagtttgaaatgtttttagcaaaatctaatttttgccataatgtgtcctccctgtccaaattgggaatgacttaatgtcaatttgtttgttggttgttttaataatacttccttatgtagccattaagatttatatgaatattttcccaaatgcccagtttttgcttaatatgtattgtgctttttagaacaaatctggataaatgtgcaaaagtacccctttgcacagatagttaatgttttatgcttccattaaataaaaaggacttaaaatctgttaattataatagaaatgcggctagttcagagagatttttagagctgtggtggacttcatagatgaattcaagtgttgagggaggattaaagaaatatataccgtgtttatgtgtgtgtgctt

SEQ ID NO: 132 - protein, 306 aa, Homo sapiens
MSEEQFGGDGAAAAATAAVGGSAGEQEGAMVAATQGAAAAAGSGAGTGGGTASGGTEGGSAESEGAKIDASKNEEDEGHSNSSPRHSEAATAQREEWKMFIGGLSWDTTKKDLKDYFSKFGEVVDCTLKLDPITGRSRGFGFVLFKESESVDKVMDQKEHKLNGKVIDPKRAKAMKTKEPVKKIFVGGLSPDTPEEKIREYFGGFGEVESIELPMDNKTNKRRGFCFITFKEEEPVKKIMEKKYHNVGLSKCEIKVAMSKEQYQQQQQWGSRGGFAGRARGRGGDQQSGYGKVSRRGGHQNSYKPY

SEQ ID NO: 133 - DNA, 2053 bp, Homo sapiens
cttccgtcggccattttaggtggtccgcggcggcgccattaaagcgaggaggaggcgagagcggccgccgctggtgcttattcttttttagtgcagcgggagagagcgggagtgtgcgccgcgcgagagtgggaggcgaagggggcaggccagggagaggcgcaggagcctttgcagccacgcgcgcgccttccctgtcttgtgtgcttcgcgaggtagagcgggcgcgcggcagcggcggggattactttgctgctagtttcggttcgcggcagcggcgggtgtagtctcggcggcagcggcggagacactagcactatgtcggaggagcagttcggcggggacggggcggcggcagcggcaacggcggcggtaggcggctcggcgggcgagcaggagggagccatggtggcggcgacacagggggcagcggcggcggcgggaagcggagccgggaccgggggcggaaccgcgtctggaggcaccgaagggggcagcgccgagtcggagggggcgaagattgacgccagtaagaacgaggaggatgaagggaaaatgtttataggaggccttagctgggacactacaaagaaagatctgaaggactacttttccaaatttggtgaagttgtagactgcactctgaagttagatcctatcacagggcgatcaaggggttttggctttgtgctatttaaagaatcggagagtgtagataaggtcatggatcaaaaagaacataaattgaatgggaaggtgattgatcctaaaagggccaaagccatgaaaacaaaagagccggttaaaaaaatttttgttggtggcctttctccagatacacctgaagagaaaataagggagtactttggtggttttggtgaggtggaatccatagagctccccatggacaacaagaccaataagaggcgtgggttctgctttattacctttaaggaagaagaaccagtgaagaagataatggaaaagaaataccacaatgttggtcttagtaaatgtgaaataaaagtagccatgtcgaaggaacaatatcagcaacagcaacagtggggatctagaggaggatttgcaggaagagctcgtggaagaggtggtgaccagcagagtggttatgggaaggtatccaggcgaggtggtcatcaaaatagctacaaaccatactaaattattccatttgcaacttatccccaacaggtggtgaagcagtattttccaatttgaagattcatttgaaggtggctcctgccacctgctaatagcagttcaaactaaattttttgtatcaagtccctgaatggaagtatgacgttgggtccctctgaagtttaattctgagttctcattaaaagaaatttgctttcattgttttatttcttaattgctatgcttcagaatcaatttgtgttttatgccctttcccccagtattgtagagcaagtcttgtgttaaaagcccagtgtgacagtgtcatgatgtagtagtgtcttactggttttttaataaatccttttgtataaaaatgtattggctcttttatcatcagaataggaaaaattgtcatggattcaagttattaaaagcataagtttggaagacaggcttgccgaaattgaggacatgattaaaattgcagtgaagtttgaaatgtttttagcaaaatctaatttttgccataatgtgtcctccctgtccaaattgggaatgacttaatgtcaatttgtttgttggttgttttaataatacttccttatgtagccattaagatttatatgaatattttcccaaatgcccagtttttgcttaatatgtattgtgctttttagaacaaatctggataaatgtgcaaaagtacccctttgcacagatagttaatgttttatgcttccattaaataaaaaggacttaaaatctgttaattataatagaaatgcggctagttcagagagatttttagagctgtggtggacttcatagatgaattcaagtgttgagggaggattaaagaaatatataccgtgtttatgtgtgtgtgctt

SEQ ID NO: 134 - protein, 287 aa, Homo sapiens
MSEEQFGGDGAAAAATAAVGGSAGEQEGAMVAATQGAAAAAGSGAGTGGGTASGGTEGGSAESEGAKIDASKNEEDEGKMFIGGLSWDTTKKDLKDYFSKFGEVVDCTLKLDPITGRSRGFGFVLFKESESVDKVMDQKEHKLNGKVIDPKRAKAMKTKEPVKKIFVGGLSPDTPEEKIREYFGGFGEVESIELPMDNKTNKRRGFCFITFKEEEPVKKIMEKKYHNVGLSKCEIKVAMSKEQYQQQQQWGSRGGFAGRARGRGGDQQSGYGKVSRRGGHQNSYKPY

SEQ ID NO: 135 - DNA, 2107 bp, Homo sapiens
gtacatgcgagcgtgtgcgcgcgtgcgcaggcggggcgaccggcgtccccggcgctcgccccgcccccgagatgacgccgtgcgtgcgcgcgcccggtccgcgcctccgccgctttttatagcggccgcgggcggcggcggcagcggttggaggttgtaggaccggcgaggaataggaatcatggcggctgcgctgttcgtgctgctgggattcgcgctgctgggcacccacggagcctccggggctgccggcttcgtccaggcgccgctgtcccagcagaggtgggtggggggcagtgtggagctgcactgcgaggccgtgggcagcccggtgcccgagatccagtggtggtttgaagggcagggtcccaacgacacctgctcccagctctgggacggcgcccggctggaccgcgtccacatccacgccacctaccaccagcacgcggccagcaccatctccatcgacacgctcgtggaggaggacacgggcacttacgagtgccgggccagcaacgacccggatcgcaaccacctgacccgggcgcccagggtcaagtgggtccgcgcccaggcagtcgtgctagtcctggaacccggcacagtcttcactaccgtagaagaccttggctccaagatactcctcacctgctccttgaatgacagcgccacagaggtcacagggcaccgctggctgaaggggggcgtggtgctgaaggaggacgcgctgcccggccagaaaacggagttcaaggtggactccgacgaccagtggggagagtactcctgcgtcttcctccccgagcccatgggcacggccaacatccagctccacgggcctcccagagtgaaggctgtgaagtcgtcagaacacatcaacgagggggagacggccatgctggtctgcaagtcagagtccgtgccacctgtcactgactgggcctggtacaagatcactgactctgaggacaaggccctcatgaacggctccgagagcaggttcttcgtgagttcctcgcagggccggtcagagctacacattgagaacctgaacatggaggccgaccccggccagtaccggtgcaacggcaccagctccaagggctccgaccaggccatcatcacgctccgcgtgcgcagccacctggccgccctctggcccttcctgggcatcgtggctgaggtgctggtgctggtcaccatcatcttcatctacgagaagcgccggaagcccgaggacgtcctggatgatgacgacgccggctctgcacccctgaagagcagcgggcagcaccagaatgacaaaggcaagaacgtccgccagaggaactcttcctgaggcaggtggcccgaggacgctccctgctccacgtctgcgccgccgccggagtccactcccagtgcttgcaagattccaagttctcacctcttaaagaaaacccaccccgtagattcccatcatacacttccttcttttttaaaaaagttgggttttctccattcaggattctgttccttaggtttttttccttctgaagtgtttcacgagagcccgggagctgctgccctgcggccccgtctgtggctttcagcctctgggtctgagtcatggccgggtgggcggcacagccttctccactggccggagtcagtgccaggtccttgccctttgtggaaagtcacaggtcacacgaggggccccgtgtcctgcctgtctgaagccaatgctgtctggttgcgccatttttgtgcttttatgtttaattttatgagggccacgggtctgtgttcgactcagcctcagggacgactctgacctcttggccacagaggactcacttgcccacaccgagggcgaccccgtcacagcctcaagtcactcccaagccccctccttgtctgtgcatccgggggcagctctggagggggtttgctggggaactggcgccatcgccgggactccagaaccgcagaagcctccccagctcacccctggaggacggccggctctctatagcaccagggctcacgtgggaacccccctcccacccaccgccacaataaagatcgcccccacctccaccctcaaaaaaaaaaaaaaaaaaaa

SEQ ID NO: 136 - protein, 385 aa, Homo sapiens
MAAALFVLLGFALLGTHGASGAAGFVQAPLSQQRWVGGSVELHCEAVGSPVPEIQWWFEGQGPNDTCSQLWDGARLDRVHIHATYHQHAASTISIDTLVEEDTGTYECRASNDPDRNHLTRAPRVKWVRAQAVVLVLEPGTVFTTVEDLGSKILLTCSLNDSATEVTGHRWLKGGVVLKEDALPGQKTEFKVDSDDQWGEYSCVFLPEPMGTANIQLHGPPRVKAVKSSEHINEGETAMLVCKSESVPPVTDWAWYKITDSEDKALMNGSESRFFVSSSQGRSELHIENLNMEADPGQYRCNGTSSKGSDQAIITLRVRSHLAALWPFLGIVAEVLVLVTIIFIYEKRRKPEDVLDDDDAGSAPLKSSGQHQNDKGKNVRQRNSS

SEQ ID NO: 137 - DNA, 1759 bp, Homo sapiens
gtacatgcgagcgtgtgcgcgcgtgcgcaggcggggcgaccggcgtccccggcgctcgccccgcccccgagatgacgccgtgcgtgcgcgcgcccggtccgcgcctccgccgctttttatagcggccgcgggcggcggcggcagcggttggaggttgtaggaccggcgaggaataggaatcatggcggctgcgctgttcgtgctgctgggattcgcgctgctgggcacccacggagcctccggggctgccggcacagtcttcactaccgtagaagaccttggctccaagatactcctcacctgctccttgaatgacagcgccacagaggtcacagggcaccgctggctgaaggggggcgtggtgctgaaggaggacgcgctgcccggccagaaaacggagttcaaggtggactccgacgaccagtggggagagtactcctgcgtcttcctccccgagcccatgggcacggccaacatccagctccacgggcctcccagagtgaaggctgtgaagtcgtcagaacacatcaacgagggggagacggccatgctggtctgcaagtcagagtccgtgccacctgtcactgactgggcctggtacaagatcactgactctgaggacaaggccctcatgaacggctccgagagcaggttcttcgtgagttcctcgcagggccggtcagagctacacattgagaacctgaacatggaggccgaccccggccagtaccggtgcaacggcaccagctccaagggctccgaccaggccatcatcacgctccgcgtgcgcagccacctggccgccctctggcccttcctgggcatcgtggctgaggtgctggtgctggtcaccatcatcttcatctacgagaagcgccggaagcccgaggacgtcctggatgatgacgacgccggctctgcacccctgaagagcagcgggcagcaccagaatgacaaaggcaagaacgtccgccagaggaactcttcctgaggcaggtggcccgaggacgctccctgctccacgtctgcgccgccgccggagtccactcccagtgcttgcaagattccaagttctcacctcttaaagaaaacccaccccgtagattcccatcatacacttccttcttttttaaaaaagttgggttttctccattcaggattctgttccttaggtttttttccttctgaagtgtttcacgagagcccgggagctgctgccctgcggccccgtctgtggctttcagcctctgggtctgagtcatggccgggtgggcggcacagccttctccactggccggagtcagtgccaggtccttgccctttgtggaaagtcacaggtcacacgaggggccccgtgtcctgcctgtctgaagccaatgctgtctggttgcgccatttttgtgcttttatgtttaattttatgagggccacgggtctgtgttcgactcagcctcagggacgactctgacctcttggccacagaggactcacttgcccacaccgagggcgaccccgtcacagcctcaagtcactcccaagccccctccttgtctgtgcatccgggggcagctctggagggggtttgctggggaactggcgccatcgccgggactccagaaccgcagaagcctccccagctcacccctggaggacggccggctctctatagcaccagggctcacgtgggaacccccctcccacccaccgccacaataaagatcgcccccacctccaccctcaaaaaaaaaaaaaaaaaaaa

SEQ ID NO: 138 - protein, 269 aa, Homo sapiens
MAAALFVLLGFALLGTHGASGAAGTVFTTVEDLGSKILLTCSLNDSATEVTGHRWLKGGVVLKEDALPGQKTEFKVDSDDQWGEYSCVFLPEPMGTANIQLHGPPRVKAVKSSEHINEGETAMLVCKSESVPPVTDWAWYKITDSEDKALMNGSESRFFVSSSQGRSELHIENLNMEADPGQYRCNGTSSKGSDQAIITLRVRSHLAALWPFLGIVAEVLVLVTIIFIYEKRRKPEDVLDDDDAGSAPLKSSGQHQNDKGKNVRQRNSS

SEQ ID NO: 139 - DNA, 1814 bp, Homo sapiens
cccgccagtgtagccacattcctgcccctttccagttagcccttcgcgttcggcttagtctgcggtcctcttgcattgcgactccgagtttaacttccaacacacactttcaacctccaagagacgcccccacctgtgtcgccccaatagcgacttttctcaccgtggtcgccgcggaacttcaagggtccttcctacccgcgttgctgagagtctgggtttacgcgtcacctcgggcgggacccgatcctccgctcctgaggcccccacaatgaagcagtcggacgcgtctccccaagaaagccggcacagtcttcactaccgtagaagaccttggctccaagatactcctcacctgctccttgaatgacagcgccacagaggtcacagggcaccgctggctgaaggggggcgtggtgctgaaggaggacgcgctgcccggccagaaaacggagttcaaggtggactccgacgaccagtggggagagtactcctgcgtcttcctccccgagcccatgggcacggccaacatccagctccacgggcctcccagagtgaaggctgtgaagtcgtcagaacacatcaacgagggggagacggccatgctggtctgcaagtcagagtccgtgccacctgtcactgactgggcctggtacaagatcactgactctgaggacaaggccctcatgaacggctccgagagcaggttcttcgtgagttcctcgcagggccggtcagagctacacattgagaacctgaacatggaggccgaccccggccagtaccggtgcaacggcaccagctccaagggctccgaccaggccatcatcacgctccgcgtgcgcagccacctggccgccctctggcccttcctgggcatcgtggctgaggtgctggtgctggtcaccatcatcttcatctacgagaagcgccggaagcccgaggacgtcctggatgatgacgacgccggctctgcacccctgaagagcagcgggcagcaccagaatgacaaaggcaagaacgtccgccagaggaactcttcctgaggcaggtggcccgaggacgctccctgctccacgtctgcgccgccgccggagtccactcccagtgcttgcaagattccaagttctcacctcttaaagaaaacccaccccgtagattcccatcatacacttccttcttttttaaaaaagttgggttttctccattcaggattctgttccttaggtttttttccttctgaagtgtttcacgagagcccgggagctgctgccctgcggccccgtctgtggctttcagcctctgggtctgagtcatggccgggtgggcggcacagccttctccactggccggagtcagtgccaggtccttgccctttgtggaaagtcacaggtcacacgaggggccccgtgtcctgcctgtctgaagccaatgctgtctggttgcgccatttttgtgcttttatgtttaattttatgagggccacgggtctgtgttcgactcagcctcagggacgactctgacctcttggccacagaggactcacttgcccacaccgagggcgaccccgtcacagcctcaagtcactcccaagccccctccttgtctgtgcatccgggggcagctctggagggggtttgctggggaactggcgccatcgccgggactccagaaccgcagaagcctccccagctcacccctggaggacggccggctctctatagcaccagggctcacgtgggaacccccctcccacccaccgccacaataaagatcgcccccacctccaccctcaaaaaaaaaaaaaaaaaaaa

SEQ ID NO: 140 - protein, 176 aa, Homo sapiens
MGTANIQLHGPPRVKAVKSSEHINEGETAMLVCKSESVPPVTDWAWYKITDSEDKALMNGSESRFFVSSSQGRSELHIENLNMEADPGQYRCNGTSSKGSDQAIITLRVRSHLAALWPFLGIVAEVLVLVTIIFIYEKRRKPEDVLDDDDAGSAPLKSSGQHQNDKGKNVRQRNSS

SEQ ID NO: 141 - DNA, 1657 bp, Homo sapiens
cccgccagtgtagccacattcctgcccctttccagttagcccttcgcgttcggcttagtctgcggtcctcttgcattgcgactccgagtttaacttccaacacacactttcaacctccaagagacgcccccacctgtgtcgccccaatagcgacttttctcaccgtggtcgccgcggaacttcaagggtccttcctacccgcgttgctgagagtctgggtttacgcgtcacctcgggcgggacccgatcctccgctcctgaggcccccacaatgaagcagtcggacgcgtctccccaagaaagggtggactccgacgaccagtggggagagtactcctgcgtcttcctccccgagcccatgggcacggccaacatccagctccacgggcctcccagagtgaaggctgtgaagtcgtcagaacacatcaacgagggggagacggccatgctggtctgcaagtcagagtccgtgccacctgtcactgactgggcctggtacaagatcactgactctgaggacaaggccctcatgaacggctccgagagcaggttcttcgtgagttcctcgcagggccggtcagagctacacattgagaacctgaacatggaggccgaccccggccagtaccggtgcaacggcaccagctccaagggctccgaccaggccatcatcacgctccgcgtgcgcagccacctggccgccctctggcccttcctgggcatcgtggctgaggtgctggtgctggtcaccatcatcttcatctacgagaagcgccggaagcccgaggacgtcctggatgatgacgacgccggctctgcacccctgaagagcagcgggcagcaccagaatgacaaaggcaagaacgtccgccagaggaactcttcctgaggcaggtggcccgaggacgctccctgctccacgtctgcgccgccgccggagtccactcccagtgcttgcaagattccaagttctcacctcttaaagaaaacccaccccgtagattcccatcatacacttccttcttttttaaaaaagttgggttttctccattcaggattctgttccttaggtttttttccttctgaagtgtttcacgagagcccgggagctgctgccctgcggccccgtctgtggctttcagcctctgggtctgagtcatggccgggtgggcggcacagccttctccactggccggagtcagtgccaggtccttgccctttgtggaaagtcacaggtcacacgaggggccccgtgtcctgcctgtctgaagccaatgctgtctggttgcgccatttttgtgcttttatgtttaattttatgagggccacgggtctgtgttcgactcagcctcagggacgactctgacctcttggccacagaggactcacttgcccacaccgagggcgaccccgtcacagcctcaagtcactcccaagccccctccttgtctgtgcatccgggggcagctctggagggggtttgctggggaactggcgccatcgccgggactccagaaccgcagaagcctccccagctcacccctggaggacggccggctctctatagcaccagggctcacgtgggaacccccctcccacccaccgccacaataaagatcgcccccacctccaccctcaaaaaaaaaaaaaaaaaaaa

SEQ ID NO: 142 - protein, 205 aa, Homo sapiens
MKQSDASPQERVDSDDQWGEYSCVFLPEPMGTANIQLHGPPRVKAVKSSEHINEGETAMLVCKSESVPPVTDWAWYKITDSEDKALMNGSESRFFVSSSQGRSELHIENLNMEADPGQYRCNGTSSKGSDQAIITLRVRSHLAALWPFLGIVAEVLVLVTIIFIYEKRRKPEDVLDDDDAGSAPLKSSGQHQNDKGKNVRQRNSS

SEQ ID NO: 143 - DNA, 1734 bp, Homo sapiens
acgcacgcacgtctctcgctttcgcatacttaaggcgtctgttctcggcagcggcacagcgaggtcggcagcggcacagcgaggtcggcagcggcacagcgaggtcggcagcggcacagcgaggtcggcagcggcagcgaggtcggcagcggcacagcgaggtcggcagcggcagcgaggtcggcagcggcgcgcgctgtgctcttccgcggactctgaatcatggcgaccacggccacgatggcgacctcgggctcggcgcgaaagcggctgctcaaagaggaagacatgactaaagtggaattcgagaccagcgaggaggtggatgtgacccccacgttcgacaccatgggcctgcgggaggacctgctgcggggcatctacgcttacggttttgaaaaaccatcagcaatccagcaacgagcaatcaagcagatcatcaaagggagagatgtcatcgcacagtctcagtccggcacaggaaaaacagccaccttcagtatctcagtcctccagtgtttggatattcaggttcgtgaaactcaagctttgatcttggctcccacaagagagttggctgtgcagatccagaaggggctgcttgctctcggtgactacatgaatgtccagtgccatgcctgcattggaggcaccaatgttggcgaggacatcaggaagctggattacggacagcatgttgtcgcgggcactccagggcgtgtttttgatatgattcgtcgcagaagcctaaggacacgtgctatcaaaatgttggttttggatgaagctgatgaaatgttgaataaaggtttcaaagagcagatttacgatgtatacaggtacctgcctccagccacacaggtggttctcatcagtgccacgctgccacacgagattctggagatgaccaacaagttcatgaccgacccaatccgcatcttggtgaaacgtgatgaattgactctggaaggcatcaagcaatttttcgtggcagtggagagggaagagtggaaatttgacactctgtgtgacctctacgacacactgaccatcactcaggcggtcatcttctgcaacaccaaaagaaaggtggactggctgacggagaaaatgagggaagccaacttcactgtatcctcaatgcatggagacatgccccagaaagagcgggagtccatcatgaaggagttccggtcgggcgccagccgagtgcttatttctacagatgtctgggccagggggttggatgtccctcaggtgtccctcatcattaactatgatctccctaataacagagaattgtacatacacagaattgggagatcaggtcgatacggccggaagggtgtggccattaactttgtaaagaatgacgacatccgcatcctcagagatatcgagcagtactattccactcagattgatgagatgccgatgaacgttgctgatcttatctgaagcagcagatcagtgggatgagggagactgttcacctgctgtgtactcctgtttggaagtatttagatccagattctacttaatggggtttatatggactttcttctcataaatggcctgccgtctcccttcctttgaagaggatatggggattctgctctcttttcttatttacatgtaaataatacattgttctaagtctttttcattaaaaatttaaaacttttcccataaactctatacttctaaggtgccaccaccttctctagtaactta

SEQ ID NO: 144 - protein, 411 aa, Homo sapiens
MATTATMATSGSARKRLLKEEDMTKVEFETSEEVDVTPTFDTMGLREDLLRGIYAYGFEKPSAIQQRAIKQIIKGRDVIAQSQSGTGKTATFSISVLQCLDIQVRETQALILAPTRELAVQIQKGLLALGDYMNVQCHACIGGTNVGEDIRKLDYGQHVVAGTPGRVFDMIRRRSLRTRAIKMLVLDEADEMLNKGFKEQIYDVYRYLPPATQVVLISATLPHEILEMTNKFMTDPIRILVKRDELTLEGIKQFFVAVEREEWKFDTLCDLYDTLTITQAVIFCNTKRKVDWLTEKMREANFTVSSMHGDMPQKERESIMKEFRSGASRVLISTDVWARGLDVPQVSLIINYDLPNNRELYIHRIGRSGRYGRKGVAINFVKNDDIRILRDIEQYYSTQIDEMPMNVADLI

SEQ ID NO: 145 - DNA, 3466 bp, Homo sapiens
aattacggccggattccggagtcctttccagctccctcttcggccgggtttcccgccgaatacaaaggcgcactgtgaactggctctttctttccgccaatcatttccgccagccattcatcaccgattttcttcatcttcccctccctcttccgtcccgcagtccccgacctgttagctctcggttagttaagggactcgggtccttccgaactgcgcatgcgccaccgcgtctgcagggggagaagcgggcaggggcgcaggcgcagtagtgtgatcccctggccagtccctaagcacgtgggttgggttgtcctgcttggctgcggagggagtggaacctcgatattggtggtgtccatcgtgggcagcggactaataaaggccatggcgccagcagaaatcctgaacgggaaggagatctccgcgcaaataagggcgagactgaaaaatcaagtcactcagttgaaggagcaagtacctggtttcacaccacgcctggcaatattacaggttggcaacagagatgattccaatctttatataaatgtgaagctgaaggctgctgaagagattgggatcaaagccactcacattaagttaccaagaacaaccacagaatctgaggtgatgaagtacattacatctttgaatgaagactctactgtacatgggttcttagtgcagctacctttagattcagagaattccattaacactgaagaagtgatcaatgctattgcacccgagaaggatgtggatggattgactagcatcaatgctgggaaacttgctagaggtgacctcaatgactgtttcattccttgtacgcctaagggatgcttggaactcatcaaagagacaggggtgccgattgccggaaggcatgctgtggtggttgggcgcagtaaaatagttggggccccgatgcatgacttgcttctgtggaacaatgccacagtgaccacctgccactccaagactgcccatctggatgaggaggtaaataaaggtgacatcctggtggttgcaactggtcagcctgaaatggttaaaggggagtggatcaaacctggggcaatagtcatcgactgtggaatcaattatgtcccagatgataaaaaaccaaatgggagaaaagttgtgggtgatgtggcatacgacgaggccaaagagagggcgagcttcatcactcctgttcctggcggcgtagggcccatgacagttgcaatgctcatgcagagcacagtagagagtgccaagcgtttcctggagaaatttaagccaggaaagtggatgattcagtataacaaccttaacctcaagacacctgttccaagtgacattgatatatcacgatcttgtaaaccgaagcccattggtaagctggctcgagaaattggtctgctgtctgaagaggtagaattatatggtgaaacaaaggccaaagttctgctgtcagcactagaacgcctgaagcaccggcctgatgggaaatacgtggtggtgactggaataactccaacacccctgggagaagggaaaagcacaactacaatcgggctagtgcaagcccttggtgcccatctctaccagaatgtctttgcgtgtgtgcgacagccttctcagggccccacctttggaataaaaggtggcgctgcaggaggcggctactcccaggtcattcctatggaagagtttaatctccacctcacaggtgacatccatgccatcactgcagctaataacctcgttgctgcggccattgatgctcggatatttcatgaactgacccagacagacaaggctctctttaatcgtttggtgccatcagtaaatggagtgagaaggttctctgacatccaaatccgaaggttaaagagactaggcattgaaaagactgaccctaccacactgacagatgaagagataaacagatttgcaagattggacattgatccagaaaccataacttggcaaagagtgttggataccaatgatagattcctgaggaagatcacgattggacaggctccaacggagaagggtcacacacggacggcccagtttgatatctctgtggccagtgaaattatggctgtcctggctctcaccacttctctagaagacatgagagagagactgggcaaaatggtggtggcatccagtaagaaaggagagcccgtcagtgccgaagatctgggggtgagtggtgcactgacagtgcttatgaaggacgcaatcaagcccaatctcatgcagacactggagggcactccagtgtttgtccatgctggcccgtttgccaacatcgcacatggcaattcctccatcattgcagaccggatcgcactcaagcttgttggcccagaagggtttgtagtgacggaagcaggatttggagcagacattggaatggaaaagttttttaacatcaaatgccggtattccggcctctgcccccacgtggtggtgcttgttgccactgtcagggctctcaagatgcacgggggcggccccacggtcactgctggactgcctcttcccaaggcttacatacaggagaacctggagctggttgaaaaaggcttcagtaacttgaagaaacaaattgaaaatgccagaatgtttggaattccagtagtagtggccgtgaatgcattcaagacggatacagagtctgagctggacctcatcagccgcctttccagagaacatggggcttttgatgccgtgaagtgcactcactgggcagaagggggcaagggtgccttagccctggctcaggccgtccagagagcagcacaagcacccagcagcttccagctcctttatgacctcaagctcccagttgaggataaaatcaggatcattgcacagaagatctatggagcagatgacattgaattacttcccgaagctcaacacaaagctgaagtctacacgaagcagggctttgggaatctccccatctgcatggctaaaacacacttgtctttgtctcacaacccagagcaaaaaggtgtccctacaggcttcattctgcccattcgcgacatccgcgccagcgttggggctggttttctgtaccccttagtaggaacgatgagcacaatgcctggactccccacccggccctgtttttatgatattgatttggaccctgaaacagaacaggtgaatggattattctaaacagatcaccatccatcttcaagaagctactttgaaagtctggccagtgtctattcaggcccactgggagttaggaagtataagtaagccaagagaagtcagcccctgcccagaagatctgaaactaatagtaggagtttccccagaagtcattttcagccttaattctcatcatgtataaattaacataaatcatgcatgtctgtttactttagtgacgttccacagaataaaaggaaacaagtttgccatcaaaaaaaaaaaaaaaaaa

SEQ ID NO: 146 - protein, 935 aa, Homo sapiens [sequence omitted]

SEQ ID NO: 147 - DNA, 2423 bp, Homo sapiens
acccgcgctcgtacgtgcgcctccgccggcagctcctgactcatcgggggctccgggtcacatgcgcccgcgcggccctataggcgcctcctccgcccgccgcccgggagccgcagccgccgccgccactgccactcccgctctctcagcgccgccgtcgccaccgccaccgccaccgccactaccaccgtctgagtctgcagtcccgagatcccagccatcatgtccatagagaagatctgggcccgggagatcctggactcccgcgggaaccccacagtggaggtggatctctatactgccaaaggtcttttccgggctgcagtgcccagtggagcctctacgggcatctatgaggccctggagctgagggatggagacaaacagcgttacttaggcaaaggtgtcctgaaggcagtggaccacatcaactccaccatcgcgccagccctcatcagctcaggtctctctgtggtggagcaagagaaactggacaacctgatgctggagttggatgggactgagaacaaatccaagtttggggccaatgccatcctgggtgtgtctctggccgtgtgtaaggcaggggcagctgagcgggaactgcccctgtatcgccacattgctcagctggccgggaactcagacctcatcctgcctgtgccggccttcaacgtgatcaatggtggctctcatgctggcaacaagctggccatgcaggagttcatgatcctcccagtgggagctgagagctttcgggatgccatgcgactaggtgcagaggtctaccatacactcaagggagtcatcaaggacaaatacggcaaggatgccaccaatgtgggggatgaaggtggctttgcccccaatatcctggagaacagtgaagccttggagctggtgaaggaagccatcgacaaggctggctacacggaaaagatcgttattggcatggatgttgctgcctcagagttttatcgtgatggcaaatatgacttggacttcaagtctcccactgatccttcccgatacatcactggggaccagctgggggcactctaccaggactttgtcagggactatcctgtggtctccattgaggacccatttgaccaggatgattgggctgcctggtccaagttcacagccaatgtagggatccagattgtgggtgatgacctgacagtgaccaacccaaaacgtattgagcgggcagtggaagaaaaggcctgcaactgtctgctgctcaaggtcaaccagatcggctcggtcactgaagccatccaagcgtgcaagctggcccaggagaatggctggggggtcatggtgagtcatcgctcaggagagactgaggacacattcattgctgacctggtggtggggctgtgcacaggccagatcaagactggtgccccgtgccgttctgaacgtctggctaaatacaaccagctcatgagaattgaggaagagctgggggatgaagctcgctttgccggacataacttccgtaatcccagtgtgctgtgattcctctgcttgcctggagacgtggaacctctgtctcatcctcctggaaccttgctgtcctgatctgtgatagttcaccccctgagatcccctgagccccagggtgcccagaacttccctgattgacctgctccgctgctccttggcttacctgacctcttgctgtctctgctcgccctcctttctgtgccctactcattggggttccgcactttccacttcttcctttctctttctctcttccctcagaaactagaaatgtgaatgaggattattataaaagggggtccgtggaagaatgatcagcatctgtgatgggagcgtcagggttggtgtgctgaggtgttagagagggaccatgtgtcacttgtgctttgctcttgtcccacgtgtcttccactttgcatatgagccgtgaactgtgcatagtgctgggatggaggggagtgttgggcatgtgatcacgcctggctaataaggctttagtgtatttatttatttatttattttatttgtttttcattcatcccattaatcatttccccataactcaatggcctaaaactggcctgacttgggggaacgatgtgtctgtatttcatgtggctgtagatcccaagatgactggggtgggaggtcttgctagaatgggaagggtcatagaaagggccttgacatcagttcctttgtgtgtactcactgaagcctgcgttggtccagagcggaggctgtgtgcctgggggagttttcctctatacatctctccccaaccctaggttccctgttcttcctccagctgcaccagagcaacctctcactccccatgccacgttccacagttgccaccacctctgtggcattgaaatgagcacctccattaaagtctgaatcagtgc

SEQ ID NO: 148 - protein, 434 aa, Homo sapiens
MSIEKIWAREILDSRGNPTVEVDLYTAKGLFRAAVPSGASTGIYEALELRDGDKQRYLGKGVLKAVDHINSTIAPALISSGLSVVEQEKLDNLMLELDGTENKSKFGANAILGVSLAVCKAGAAERELPLYRHIAQLAGNSDLILPVPAFNVINGGSHAGNKLAMQEFMILPVGAESFRDAMRLGAEVYHTLKGVIKDKYGKDATNVGDEGGFAPNILENSEALELVKEAIDKAGYTEKIVIGMDVAASEFYRDGKYDLDFKSPTDPSRYITGDQLGALYQDFVRDYPVVSIEDPFDQDDWAAWSKFTANVGIQIVGDDLTVTNPKRIERAVEEKACNCLLLKVNQIGSVTEAIQACKLAQENGWGVMVSHRSGETEDTFIADLVVGLCTGQIKTGAPCRSERLAKYNQLMRIEEELGDEARFAGHNFRNPSVL

SEQ ID NO: 149 - DNA, 628 bp, Homo sapiens
tgacccacttccgttacttgctgcggaggaccgtgggcagccagggtcggtgaaggatcccaaaatggctgggcgaaaacttgctctaaaaaccattgactgggtagcttttgcagagatcataccccagaaccaaaaggccattgctagttccctgaaatcctggaatgagaccctcacctccaggttggctgctttacctgagaatccaccagctatcgactgggcttactacaaggccaatgtggccaaggctggcttggtggatgactttgagaagaagtttaatgcgctgaaggttcccgtgccagaggataaatatactgcccaggtggatgccgaagaaaaagaagatgtgaaatcttgtgctgagtgggtgtctctctcaaaggccaggattgtagaatatgagaaagagatggagaagatgaagaacttaattccatttgatcagatgaccattgaggacttgaatgaagctttcccagaaaccaaattagacaagaaaaagtatccctattggcctcaccaaccaattgagaatttataaaattgagtccaggaggaagctctggcccttgtattacacattctggacattaaaaataataattatacagttaaaaaa

SEQ ID NO: 150 - protein, 161 aa, Homo sapiens
MAGRKLALKTIDWVAFAEIIPQNQKAIASSLKSWNETLTSRLAALPENPPAIDWAYYKANVAKAGLVDDFEKKFNALKVPVPEDKYTAQVDAEEKEDVKSCAEWVSLSKARIVEYEKEMEKMKNLIPFDQMTIEDLNEAFPETKLDKKKYPYWPHQPIENL

SEQ ID NO: 151 - DNA, 556 bp, Homo sapiens
tgacccacttccgttacttgctgcggaggaccgtgggcagccagggtcggtgaaggatcccaaaatggctgggcgaaaacttgctctaaaaaccattgactgggtagcttttgcagagatcataccccagaaccaaaaggccattgctagttccctgaaatcctggaatgagaccctcacctccaggttggctgctttacctgagaatccaccagctatcgactgggcttactacaaggccaatgtggccaaggctggcttggtggatgactttgagaagaaggtgaaatcttgtgctgagtgggtgtctctctcaaaggccaggattgtagaatatgagaaagagatggagaagatgaagaacttaattccatttgatcagatgaccattgaggacttgaatgaagctttcccagaaaccaaattagacaagaaaaagtatccctattggcctcaccaaccaattgagaatttataaaattgagtccaggaggaagctctggcccttgtattacacattctggacattaaaaataataattatacagttaaaaaa

SEQ ID NO: 152 - protein, 137 aa, Homo sapiens
MAGRKLALKTIDWVAFAEIIPQNQKAIASSLKSWNETLTSRLAALPENPPAIDWAYYKANVAKAGLVDDFEKKVKSCAEWVSLSKARIVEYEKEMEKMKNLIPFDQMTIEDLNEAFPETKLDKKKYPYWPHQPIENL

SEQ ID NO: 153 - DNA, 2310 bp, Homo sapiens
gaggaagccccgccccgcgcagccccgtcccgccccttcccatcgtgtacggtcccgcgtggctgcgcgcggcgctctgggagtacgacatggcgcgcgagctgcgggcgctgctgctgtggggccgccgcctgcggcctttgctgcgggcgccggcgctggcggccgtgccgggaggaaaaccaattctgtgtcctcggaggaccacagcccagttgggccccaggcgaaacccagcctggagcttgcaggcaggacgactgttcagcacgcagaccgccgaggacaaggaggaacccctgcactcgattatcagcagcacagagagcgtgcagggttccacttccaaacatgagttccaggccgagacaaagaagcttttggacattgttgcccggtccctgtactcagaaaaagaggtgtttatacgggagctgatctccaatgccagcgatgccttggaaaaactgcgtcacaaactggtgtctgacggccaagcactgccagaaatggagattcacttgcagaccaatgccgagaaaggcaccatcaccatccaggatactggtatcgggatgacacaggaagagctggtgtccaacctggggacgattgccagatcggggtcaaaggccttcctggatgctctgcagaaccaggctgaggccagcagcaagatcatcggccagtttggagtgggtttctactcagctttcatggtggctgacagagtggaggtctattcccgctcggcagccccggggagcctgggttaccagtggctttcagatggttctggagtgtttgaaatcgccgaagcttcgggagttagaaccgggacaaaaatcatcatccacctgaaatccgactgcaaggagttttccagcgaggcccgggtgcgagatgtggtaacgaagtacagcaacttcgtcagcttccccttgtacttgaatggaaggcggatgaacaccttgcaggccatctggatgatggaccccaaggatgtccgtgagtggcaacatgaggagttctaccgctacgtcgcgcaggctcacgacaagccccgctacaccctgcactataagacggacgcaccgctcaacatccgcagcatcttctacgtgcccgacatgaaaccgtccatgtttgatgtgagccgggagctgggctccagcgttgcactgtacagccgcaaagtcctcatccagaccaaggccacggacatcctgcccaagtggctgcgcttcatccgaggtgtggtggacagtgaggacattcccctgaacctcagccgggagctgctgcaggagagcgcactcatcaggaaactccgggacgttttacagcagaggctgatcaaattcttcattgaccagagtaaaaaagatgctgagaagtatgcaaagttttttgaagattacggcctgttcatgcgggagggcattgtgaccgccaccgagcaggaggtcaaggaggacatagcaaagctgctgcgctacgagtcctcggcgctgccctccgggcagctaaccagcctctcagaatacgccagccgcatgcgggccggcacccgcaacatctactacctgtgcgcccccaaccgtcacctggcagagcactcaccctactatgaggccatgaagaagaaagacacagaggttctcttctgctttgagcagtttgatgagctcaccctgctgcaccttcgtgagtttgacaagaagaagctgatctctgtggagacggacatagtcgtggatcactacaaggaggagaagtttgaggacaggtccccagccgccgagtgcctatcagagaaggagacggaggagctcatggcctggatgagaaatgtgctggggtcgcgtgtcaccaacgtgaaggtgaccctccgactggacacccaccctgccatggtcaccgtgctggagatgggggctgcccgccacttcctgcgcatgcagcagctggccaagacccaggaggagcgcgcacagctcctgcagcccacgctggagatcaaccccaggcacgcgctcatcaagaagctgaatcagctgcgcgcaagcgagcctggcctggctcagctgctggtggatcagatatacgagaacgccatgattgctgctggacttgttgacgaccctagggccatggtgggccgcttgaatgagctgcttgtcaaggccctggagcgacactgacagccagggggccagaaggactgacaccacagatgacagccccacctccttgagctttatttacctaaatttaaaggtatttcttaacccgaaaaaaaaaaaaaaa

SEQ ID NO: 154 - protein, 704 aa, Homo sapiens
MARELRALLLWGRRLRPLLRAPALAAVPGGKPILCPRRTTAQLGPRRNPAWSLQAGRLFSTQTAEDKEEPLHSIISSTESVQGSTSKHEFQAETKKLLDIVARSLYSEKEVFIRELISNASDALEKLRHKLVSDGQALPEMEIHLQTNAEKGTITIQDTGIGMTQEELVSNLGTIARSGSKAFLDALQNQAEASSKIIGQFGVGFYSAFMVADRVEVYSRSAAPGSLGYQWLSDGSGVFEIAEASGVRTGTKIIIHLKSDCKEFSSEARVRDVVTKYSNFVSFPLYLNGRRMNTLQAIWMMDPKDVREWQHEEFYRYVAQAHDKPRYTLHYKTDAPLNIRSIFYVPDMKPSMFDVSRELGSSVALYSRKVLIQTKATDILPKWLRFIRGVVDSEDIPLNLSRELLQESALIRKLRDVLQQRLIKFFIDQSKKDAEKYAKFFEDYGLFMREGIVTATEQEVKEDIAKLLRYESSALPSGQLTSLSEYASRMRAGTRNIYYLCAPNRHLAEHSPYYEAMKKKDTEVLFCFEQFDELTLLHLREFDKKKLISVETDIVVDHYKEEKFEDRSPAAECLSEKETEELMAWMRNVLGSRVTNVKVTLRLDTHPAMVTVLEMGAARHFLRMQQLAKTQEERAQLLQPTLEINPRHALIKKLNQLRASEPGLAQLLVDQIYENAMIAAGLVDDPRAMVGRLNELLVKALERH

SEQ ID NO: 155 - DNA, 2405 bp, Homo sapiens
tccggcgtggtgcgcaggcgcggtatcccccctcccccgccagctcgaccccggtgtggtgcgcaggcgcagtctgcgcagggactggcgggactgcgcggcggcaacagcagacatgtcgggggtccggggcctgtcgcggctgctgagcgctcggcgcctggcgctggccaaggcgtggccaacagtgttgcaaacaggaacccgaggttttcacttcactgttgatgggaacaagagggcatctgctaaagtttcagattccatttctgctcagtatccagtagtggatcatgaatttgatgcagtggtggtaggcgctggaggggcaggcttgcgagctgcatttggcctttctgaggcagggtttaatacagcatgtgttaccaagctgtttcctaccaggtcacacactgttgcagcacagggaggaatcaatgctgctctggggaacatggaggaggacaactggaggtggcatttctacgacaccgtgaagggctccgactggctgggggaccaggatgccatccactacatgacggagcaggcccccgccgccgtggtcgagctagaaaattatggcatgccgtttagcagaactgaagatgggaagatttatcagcgtgcatttggtggacagagcctcaagtttggaaagggcgggcaggcccatcggtgctgctgtgtggctgatcggactggccactcgctattgcacaccttatatggaaggtctctgcgatatgataccagctattttgtggagtattttgccttggatctcctgatggagaatggggagtgccgtggtgtcatcgcactgtgcatagaggacgggtccatccatcgcataagagcaaagaacactgttgttgccacaggaggctacgggcgcacctacttcagctgcacgtctgcccacaccagcactggcgacggcacggccatgatcaccagggcaggccttccttgccaggacctagagtttgttcagttccaccctacaggcatatatggtgctggttgtctcattacggaaggatgtcgtggagagggaggcattctcattaacagtcaaggcgaaaggtttatggagcgatacgcccctgtcgcgaaggacctggcgtctagagatgtggtgtctcggtccatgactctggagatccgagaaggaagaggctgtggccctgagaaagatcacgtctacctgcagctgcaccacctacctccagagcagctggccacgcgcctgcctggcatttcagagacagccatgatcttcgctggcgtggacgtcacgaaggagccgatccctgtcctccccaccgtgcattataacatgggcggcattcccaccaactacaaggggcaggtcctgaggcacgtgaatggccaggatcagattgtgcccggcctgtacgcctgtggggaggccgcctgtgcctcggtacatggtgccaaccgcctcggggcaaactcgctcttggacctggttgtctttggtcgggcatgtgccctgagcatcgaagagtcatgcaggcctggagataaagtccctccaattaaaccaaacgctggggaagaatctgtcatgaatcttgacaaattgagatttgctgatggaagcataagaacatcggaactgcgactcagcatgcagaagtcaatgcaaaatcatgctgccgtgttccgtgtgggaagcgtgttgcaagaaggttgtgggaaaatcagcaagctctatggagacctaaagcacctgaagacgttcgaccggggaatggtctggaacacggacctggtggagaccctggagctgcagaacctgatgctgtgtgcgctgcagaccatctacggagcagaggcacggaaggagtcacggggcgcgcatgccagggaagactacaaggtgcggattgatgagtacgattactccaagcccatccaggggcaacagaagaagccctttgaggagcactggaggaagcacaccctgtcctatgtggacgttggcactgggaaggtcactctggaatatagacccgtgatcgacaaaactttgaacgaggctgactgtgccaccgtcccgccagccattcgctcctactgatgagacaagatgtggtgatgacagaatcagcttttgtaattatgtataatagctcatgcatgtgtccatgtcataactgtcttcatacgcttctgcactctggggaagaaggagtacattgaagggagattggcacctagtggctgggagcttgccaggaacccagtggccagggagcgtggcacttacctttgtcccttgcttcattcttgtgagatgataaaactgggcacagctcttaaataaaatataaatgaacaaactttcttttatttccaaaaaaaaaaaaaaaaaa

SEQ ID NO: 156 - protein, 664 aa, Homo sapiens
MSGVRGLSRLLSARRLALAKAWPTVLQTGTRGFHFTVDGNKRASAKVSDSISAQYPVVDHEFDAVVVGAGGAGLRAAFGLSEAGFNTACVTKLFPTRSHTVAAQGGINAALGNMEEDNWRWHFYDTVKGSDWLGDQDAIHYMTEQAPAAVVELENYGMPFSRTEDGKIYQRAFGGQSLKFGKGGQAHRCCCVADRTGHSLLHTLYGRSLRYDTSYFVEYFALDLLMENGECRGVIALCIEDGSIHRIRAKNTVVATGGYGRTYFSCTSAHTSTGDGTAMITRAGLPCQDLEFVQFHPTGIYGAGCLITEGCRGEGGILINSQGERFMERYAPVAKDLASRDVVSRSMTLEIREGRGCGPEKDHVYLQLHHLPPEQLATRLPGISETAMIFAGVDVTKEPIPVLPTVHYNMGGIPTNYKGQVLRHVNGQDQIVPGLYACGEAACASVHGANRLGANSLLDLVVFGRACALSIEESCRPGDKVPPIKPNAGEESVMNLDKLRFADGSIRTSELRLSMQKSMQNHAAVFRVGSVLQEGCGKISKLYGDLKHLKTFDRGMVWNTDLVETLELQNLMLCALQTIYGAEARKESRGAHAREDYKVRIDEYDYSKPIQGQQKKPFEEHWRKHTLSYVDVGTGKVTLEYRPVIDKTLNEADCATVPPAIRSY

SEQ ID NO: 157 - DNA, 2630 bp, Homo sapiens
ataaggccctctcctccaccctgccaggctcactctgccccacagccacagcccctgactgccgcagcccccacagagcccgccgcgcaccccacgtcccccacgccagcgcccagccatggaggccatcaagaagaaaatgcagatgctgaagttggacaaggagaatgccatcgaccgcgcggagcaggcggaggcggataagaaagccgctgaggacaagtgcaagcaggtggaggaggagctgacgcacctccagaagaaactaaaagggacagaggacgagctggataaatattccgaggacctgaaggacgcgcaggagaagctggagctcacggagaagaaggcctccgacgctgaaggtgatgtggccgccctcaaccgacgcatccagctcgttgaggaggagttggacagggctcaggaacgactggccacggccctgcagaagctggaggaggcagaaaaagctgcagatgagagtgagagaggaatgaaggtgatagaaaaccgggccatgaaggatgaggagaagatggagattcaggagatgcagctcaaagaggccaagcacattgcggaagaggctgaccgcaaatacgaggaggtagctcgtaagctggtcatcctggagggtgagctggagagggcagaggagcgtgcggaggtgtctgaactaaaatgtggtgacctggaagaagaactcaagaatgttactaacaatctgaaatctctggaggctgcatctgaaaagtattctgaaaaggaggacaaatatgaagaagaaattaaacttctgtctgacaaactgaaagaggctgagacccgtgctgaatttgcagagagaacggttgcaaaactggaaaagacaattgatgacctggaagagaaacttgcccaggccaaagaagagaacgtgggcttacatcagacactggatcagacactaaacgaacttaactgtatataagcaaaacagaagagtcttgttccaacagaaactctggagctccgtgggtctttctcttctcttgtaagaagttccttttgttattgccatcttcgctttgctggaaatgtcaagcaaattatgaatacatgaccaaatattttgtatcggagaagctttgagcaccagttaaatctcattccttccctttttttttcaaatggcaccagctttttcagctctcttattttttccttaagtagcatttattcctaaggtaggcagggtatttcctagtaagcatactttcttaagacggaggccatttggttcctgggagaataggcagccccacactttgaagaatacagaccccagtatctagtcgtggatataattaaaacgctgaagaccataaccttttgggtcaactgttggtcaaactataggagagaccagggaccatcacatgggtagggattttccatccagagccaataaaaggactggtgggggccgggggtggctattgtgggaagtcataacccacagatagatcaacctaagaatcctggcccttctccactctccaccatgcaggacaaacatcttctcaagcagtcaacgtagaatgcttgggaaatagtcataattacccacatatagtaattaatagatggtaattaattgatccttgatgtgatgttcttttgcatatttccttcattctaaagttgttccctggccgggagcgttggctttcgcctgtaatcccaacactttgggaggccaggacagatcacttgaggtcaggagttcgagaccagcccagccaacatggcgaaaccatgtctctactaaaaatacaaaaattatggtgacgcctgcctgtagtcccagctactcgggaggctgaggcaggaggatcgcttgaacccaggaagtggagactgcagtgagccgatatcgcaccacagcgctccagcctggtcgacagagtgagactccatctcaagaaaaaataaaaataaagttgttctctgaagagcaaatgtctcattccagtaatgacccactcagcaggaatatggtggagttcagtccaattcaggtcagccatatccaaaagaccacaagtcattactaagttgagcaaaagagtttttatctattagcagaaagggcctctctggcagcagagattaaaaactggcccaacttcatttccatacttcagggaacagcaaattgaggatttacttatctaggacttgaattccttctttgggaccaagttaataaaagaccaagaaactcctgattaaactggataatgaaggattctgtagacagggctgcacgtatcggctttgtttgacttctcttttctcagttaacatctcagagctagaacattccacattccccagcagcgtgtgggggctgactaaagtttacaattccaactaaaaatcaccctgcttctggcttatctgaatcccttacccaccccaccccaccaccctactcctatttattcagcaccacactacccaggaaatacactagcaaattgtgcaatggaataaaatccacactttagattcttgcaactgtatcatatgtaatagtatcactttttctacattttggtcaaataaatttttacataaactac

SEQ ID NO: 158 - protein, 284 aa, Homo sapiens
MEAIKKKMQMLKLDKENAIDRAEQAEADKKAAEDKCKQVEEELTHLQKKLKGTEDELDKYSEDLKDAQEKLELTEKKASDAEGDVAALNRRIQLVEEELDRAQERLATALQKLEEAEKAADESERGMKVIENRAMKDEEKMEIQEMQLKEAKHIAEEADRKYEEVARKLVILEGELERAEERAEVSELKCGDLEEELKNVTNNLKSLEAASEKYSEKEDKYEEEIKLLSDKLKEAETRAEFAERTVAKLEKTIDDLEEKLAQAKEENVGLHQTLDQTLNELNCI

SEQ ID NO: 159 - DNA, 2645 bp, Homo sapiens
tttccagcagctgtggccagcggtgccgacgtcaggccctcccccagcggtgctgacgtcggcggtccggccgggtgacctcatcgccccgacggcagccggcccggggggcggggagaggcgggggcggcccccgcgcaggcaaaggcttggggggccggggcgcggctgtgcagctctcgccggagccgagcccagccgagcgtccgccgctgcccgtgcgcctctgcgcctccgcgccatggccggcctcaactccctggaggcggtgaaacgcaagatccaggccctgcagcagcaggcggacgaggcggaagaccgcgcgcagggcctgcagcgggagctggacggcgagcgcgagcggcgcgagaaagctgaaggtgatgtggccgccctcaaccgacgcatccagctcgttgaggaggagttggacagggctcaggaacgactggccacggccctgcagaagctggaggaggcagaaaaagctgcagatgagagtgagagaggaatgaaggtgatagaaaaccgggccatgaaggatgaggagaagatggagattcaggagatgcagctcaaagaggccaagcacattgcggaagaggctgaccgcaaatacgaggaggtagctcgtaagctggtcatcctggagggtgagctggagagggcagaggagcgtgcggaggtgtctgaactaaaatgtggtgacctggaagaagaactcaagaatgttactaacaatctgaaatctctggaggctgcatctgaaaagtattctgaaaaggaggacaaatatgaagaagaaattaaacttctgtctgacaaactgaaagaggctgagacccgtgctgaatttgcagagagaacggttgcaaaactggaaaagacaattgatgacctggaagagaaacttgcccaggccaaagaagagaacgtgggcttacatcagacactggatcagacactaaacgaacttaactgtatataagcaaaacagaagagtcttgttccaacagaaactctggagctccgtgggtctttctcttctcttgtaagaagttccttttgttattgccatcttcgctttgctggaaatgtcaagcaaattatgaatacatgaccaaatattttgtatcggagaagctttgagcaccagttaaatctcattccttccctttttttttcaaatggcaccagctttttcagctctcttattttttccttaagtagcatttattcctaaggtaggcagggtatttcctagtaagcatactttcttaagacggaggccatttggttcctgggagaataggcagccccacactttgaagaatacagaccccagtatctagtcgtggatataattaaaacgctgaagaccataaccttttgggtcaactgttggtcaaactataggagagaccagggaccatcacatgggtagggattttccatccagagccaataaaaggactggtgggggccgggggtggctattgtgggaagtcataacccacagatagatcaacctaagaatcctggcccttctccactctccaccatgcaggacaaacatcttctcaagcagtcaacgtagaatgcttgggaaatagtcataattacccacatatagtaattaatagatggtaattaattgatccttgatgtgatgttcttttgcatatttccttcattctaaagttgttccctggccgggagcgttggctttcgcctgtaatcccaacactttgggaggccaggacagatcacttgaggtcaggagttcgagaccagcccagccaacatggcgaaaccatgtctctactaaaaatacaaaaattatggtgacgcctgcctgtagtcccagctactcgggaggctgaggcaggaggatcgcttgaacccaggaagtggagactgcagtgagccgatatcgcaccacagcgctccagcctggtcgacagagtgagactccatctcaagaaaaaataaaaataaagttgttctctgaagagcaaatgtctcattccagtaatgacccactcagcaggaatatggtggagttcagtccaattcaggtcagccatatccaaaagaccacaagtcattactaagttgagcaaaagagtttttatctattagcagaaagggcctctctggcagcagagattaaaaactggcccaacttcatttccatacttcagggaacagcaaattgaggatttacttatctaggacttgaattccttctttgggaccaagttaataaaagaccaagaaactcctgattaaactggataatgaaggattctgtagacagggctgcacgtatcggctttgtttgacttctcttttctcagttaacatctcagagctagaacattccacattccccagcagcgtgtgggggctgactaaagtttacaattccaactaaaaatcaccctgcttctggcttatctgaatcccttacccaccccaccccaccaccctactcctatttattcagcaccacactacccaggaaatacactagcaaattgtgcaatggaataaaatccacactttagattcttgcaactgtatcatatgtaatagtatcactttttctacattttggtcaaataaatttttacataaactac

SEQ ID NO: 160 - protein, 248 aa, Homo sapiens
MAGLNSLEAVKRKIQALQQQADEAEDRAQGLQRELDGERERREKAEGDVAALNRRIQLVEEELDRAQERLATALQKLEEAEKAADESERGMKVIENRAMKDEEKMEIQEMQLKEAKHIAEEADRKYEEVARKLVILEGELERAEERAEVSELKCGDLEEELKNVTNNLKSLEAASEKYSEKEDKYEEEIKLLSDKLKEAETRAEFAERTVAKLEKTIDDLEEKLAQAKEENVGLHQTLDQTLNELNCI

SEQ ID NO: 161 - DNA, 1369 bp, Homo sapiens
attaggtgactggctgaggcggcgccagttggccgggcacggggctgctgtaaggccgaggttgcggcggaagcggagaccatgttccgagcggcggctccggggcagctccggcgggcggcctcattgctacgatttcagagtaccctggtaatagctgagcatgcaaatgattccctagcacccattactttaaataccattactgcagccacacgccttggaggtgaagtgtcctgcttagtagctggaaccaaatgtgacaaggtggcacaagatctctgtaaagtagcaggcatagcaaaagttctggtggctcagcatgatgtgtacaaaggcctacttccagaggaactgacaccattgattttggcaactcagaagcagttcaattacacacacatctgtgctggagcatctgccttcggaaagaaccttttgcccagagtagcagccaaacttgaggttgccccgatttctgacatcattgcaatcaagtcacctgacacatttgtgagaactatttatgcaggaaatgctctatgtacagtgaagtgtgatgagaaagtgaaagtgttttctgtccgtggaacatcctttgatgctgcagcaacaagtggcggtagtgccagttcagaaaaggcatcaagtacttcaccagtggaaatatcagagtggcttgaccagaaattaacaaaaagtgatcgaccagagctaacaggtgccaaagtggtggtatctggtggtcgaggcttgaagagtggagagaactttaagttgttatatgacttggcagatcaactacatgctgcagttggtgcttcccgtgctgctgttgatgctggctttgttcccaatgacatgcaagttggacagacgggaaaaatagtagcaccagaactttatattgctgttggaatatctggagccatccaacatttagctgggatgaaagacagcaagacaattgtggcaattaataaagacccagaagctccaattttccaagtggcagattatggaatagttgcagatttatttaaggtagttcctgaaatgactgagatattgaagaaaaaatgaatcaggatcatgccttaaaaagaaaacttttgttaaagtattccactgaaatcacagatatttgtgggtattataacaatcattggaaagcatggagagctacatttcataatttgagggaaaatttctaacagatgccagaatgcttgtttatgggattgctgtgtttccttttaattatttgtggttccaaacaattattgtttgaactttttaaattctgtactaaaatctataataaagcttttccacagctttaaaactatcagaaaaaaaaaaaaaaaaa

SEQ ID NO: 162 - protein, 333 aa, Homo sapiens
MFRAAAPGQLRRAASLLRFQSTLVIAEHANDSLAPITLNTITAATRLGGEVSCLVAGTKCDKVAQDLCKVAGIAKVLVAQHDVYKGLLPEELTPLILATQKQFNYTHICAGASAFGKNLLPRVAAKLEVAPISDIIAIKSPDTFVRTIYAGNALCTVKCDEKVKVFSVRGTSFDAAATSGGSASSEKASSTSPVEISEWLDQKLTKSDRPELTGAKVVVSGGRGLKSGENFKLLYDLADQLHAAVGASRAAVDAGFVPNDMQVGQTGKIVAPELYIAVGISGAIQHLAGMKDSKTIVAINKDPEAPIFQVADYGIVADLFKVVPEMTEILKKK

SEQ ID NO: 163 - DNA, 1222 bp, Homo sapiens
attaggtgactggctgaggcggcgccagttggccgggcacggggctgctgtaaggccgaggttgcggcggaagcggagaccatgttccgagcggcggctccggggcagctccggcgggcggtggcacaagatctctgtaaagtagcaggcatagcaaaagttctggtggctcagcatgatgtgtacaaaggcctacttccagaggaactgacaccattgattttggcaactcagaagcagttcaattacacacacatctgtgctggagcatctgccttcggaaagaaccttttgcccagagtagcagccaaacttgaggttgccccgatttctgacatcattgcaatcaagtcacctgacacatttgtgagaactatttatgcaggaaatgctctatgtacagtgaagtgtgatgagaaagtgaaagtgttttctgtccgtggaacatcctttgatgctgcagcaacaagtggcggtagtgccagttcagaaaaggcatcaagtacttcaccagtggaaatatcagagtggcttgaccagaaattaacaaaaagtgatcgaccagagctaacaggtgccaaagtggtggtatctggtggtcgaggcttgaagagtggagagaactttaagttgttatatgacttggcagatcaactacatgctgcagttggtgcttcccgtgctgctgttgatgctggctttgttcccaatgacatgcaagttggacagacgggaaaaatagtagcaccagaactttatattgctgttggaatatctggagccatccaacatttagctgggatgaaagacagcaagacaattgtggcaattaataaagacccagaagctccaattttccaagtggcagattatggaatagttgcagatttatttaaggtagttcctgaaatgactgagatattgaagaaaaaatgaatcaggatcatgccttaaaaagaaaacttttgttaaagtattccactgaaatcacagatatttgtgggtattataacaatcattggaaagcatggagagctacatttcataatttgagggaaaatttctaacagatgccagaatgcttgtttatgggattgctgtgtttccttttaattatttgtggttccaaacaattattgtttgaactttttaaattctgtactaaaatctataataaagcttttccacagctttaaaactatcagaaaaaaaaaaaaaaaaa

SEQ ID NO: 164 - protein, 284 aa, Homo sapiens
MFRAAAPGQLRRAVAQDLCKVAGIAKVLVAQHDVYKGLLPEELTPLILATQKQFNYTHICAGASAFGKNLLPRVAAKLEVAPISDIIAIKSPDTFVRTIYAGNALCTVKCDEKVKVFSVRGTSFDAAATSGGSASSEKASSTSPVEISEWLDQKLTKSDRPELTGAKVVVSGGRGLKSGENFKLLYDLADQLHAAVGASRAAVDAGFVPNDMQVGQTGKIVAPELYIAVGISGAIQHLAGMKDSKTIVAINKDPEAPIFQVADYGIVADLFKVVPEMTEILKKK

SEQ ID NO: 165 - DNA, 903 bp, Homo sapiens
agataaggccgctcgctgacgccgtgtttcctctttcggccgcgctggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggagaaagagaactagtgctgagggcctcaataaagtttgtgtttatgccaaaaaaaaaaaaaaaaaaaaaaaaaaaaa

SEQ ID NO: 166 - protein, 257 aa, Homo sapiens [sequence omitted]

SEQ ID NO: 167 - DNA, 967 bp, Homo sapiens
gcggcatgggcagtatccgccgccatcctcttccgtgaggcgcgctgagacccggaccggccctcctgagaggatgccggtgcgggcgcccgcggagagggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggagaaagagaactagtgctgagggcctcaataaagtttgtgtttatgccaaaaaaaaaaaaaaaaaaaaaaaaaaaaaaaaaaaaaaaaaaaaaaaa

SEQ ID NO: 168 - protein, 257 aa, Homo sapiens [sequence omitted]

SEQ ID NO: 169 - DNA, 4032 bp, Homo sapiens
gaagacgtggcttggggccgccatcttggcaagaggcgaagcggcagcggttcctgtcaagggggcagcaggtccagagctgctggtgctcccgttccccagaccctacccctatccccagtggagccggagtgcgggcgcgccccaccaccgccctcaccatggtgctgttggcagcagcggtctgcacaaaagcaggaaaggctattgtttctcgacagtttgtggaaatgacccgaactcggattgagggcttattagcagcttttccaaagctcatgaacactggaaaacaacatacgtttgttgaaacagagagtgtaagatatgtctaccagcctatggagaaactgtatatggtactgatcactaccaaaaacagcaacattttagaagatttggagaccctaaggctcttctcaagagtgatccctgaatattgccgagccttagaagagaatgaaatatctgagcactgttttgatttgatttttgcttttgatgaaattgtcgcactgggataccgggagaatgttaacttggcacagatcagaaccttcacagaaatggattctcatgaggagaaggtgttcagagccgtcagagagactcaagaacgtgaagctaaggctgagatgcgtcgtaaagcaaaggaattacaacaggcccgaagagatgcagagagacagggcaaaaaagcaccaggatttggcggatttggcagctctgcagtatctggaggcagcacagctgccatgatcacagagaccatcattgaaactgataaaccaaaagtggcacctgcaccagccaggccttcaggccccagcaaggctttaaaacttggagccaaaggaaaggaagtagataactttgtggacaaattaaaatctgaaggtgaaaccatcatgtcctctagtatgggcaagcgtacttctgaagcaaccaaaatgcatgctccacccattaatatggaaagtgtacatatgaagattgaagaaaagataacattaacctgtggacgagacggaggattacagaatatggagttgcatggcatgatcatgcttaggatctcagatgacaagtatggccgaattcgtcttcatgtggaaaatgaagataagaaaggggtgcagctacagacccatccaaatgtggataaaaaacttttcactgcagagtctctaattggcctgaagaatccagagaagtcatttccagtcaacagtgacgtaggggtgctaaagtggagactacaaaccacagaggaatcttttattccactgacaattaattgctggccctcggagagtggaaatggctgtgatgtcaacatagaatatgagctacaagaagataatttagaactgaatgatgtggttatcaccatcccactcccgtctggtgtcggcgcgcctgttatcggtgagatcgatggggagtatcgacatgacagtcgacgaaataccctggagtggtgcctgcctgtgattgatgccaaaaataagagtggcagcctggagtttagcattgctgggcagcccaatgacttcttccctgttcaagtttcctttgtctccaagaaaaattactgtaacatacaggttaccaaagtgacccaggtagatggaaacagccccgtcaggttttccacagagaccactttcctagtggataagtatgaaattctgtaataccaagaagagggagctgaaaaggaaaattttcagattaataaagaagacgccaatgatggctgaagagtttttcccagatttacaagccactggagaccccttttttctgatacaatgcacgattctctgcgcgcaaggaccctcgactcacccccatgtttcagtgtcacagagacattctttgataaggaaatggcacaaacataaagggaaaggctgctaattttctttggcagattgtattggccagcaggaaagcaagctctccagagaatgcccccagttaaatacctcctctacctttacctaagttgctcctttatttttattttattattattattattattattattattttttgagatggagtctcactttgtaacccaggctggaatgcaatggcatgatctcagctcactgcaacctccgcctcctgggttcaagcaagtctcctgcctcagcctccgagtagctgggactacaggtgcacgccaccacgcctggctaattttttgtattttagtagagacggggtttcaccgtgttgcccaggctggtcgcgaactcctgagctcaggcaatccgcccacctcagcctcccaaagtgttgggattacaggcatgagccaccatgcccagctgctcctttattttaatccctaaatataatccctaaatatagttatatttcatacttagtttgtttttaaaaagttttctctgtagaaaattttaatcattcataccctttacctttaggtttttctttctatacattcagtcaggcactgggatcatctgtttacaggcattatatttatttggcactcctggaacaagtatatctaacccattcttgatttttggactattcaggtgaactatttgaggggtatggggtctagaagttaaaagatacgcatgtcttctgttcttttcccgtatcaattcattccttcatctctttgccaagttgttttcctttcagggcctgtccttccagtttagaacagtaccatgaatcccacttgtgtcaatattaaagatagctgagaagcacctttcaaatggcacagtccctcttcaagatgtctaaaagaatggttatgtctgtccagttagggatttcacatccacatgtaatcatgtctgctgctgttgctacccaaattttcatttctccacattttgggtacttaagctaaaacgtaatggccacagtctgtaatccattcacattcctcagtttcaccacctccctcttccagactgcactctctgtcatcagtcccctcctttctaacagaaatggggttatgattttgaaggctgtgggttcagggagtctttgccaatcctgttggccctaaactatcaaggaggctccatttcaccatttgattttttgcatttcaggaggcaactgattgtttcgatatgtacatattactcacgtataccccatttccttccagtcagcccaacattttccaccagtctgtccccatctctgaaatccttccttctctttccccctaagtcttttgagtgtcatcatgtactggtggtttctcggttccatctcatccatttccttttcaatggagactacagcgtcagccagctcagccttggcttttaactcaatattccagtccataggggtggttaaaagttgctgcaaggctgcaggcactggcagtgggaagaggcagacgactagatgacttctgcacttttagctggttgaaaagtaccactcccactctgaacatctggccgtccctgcaaagagtgtactgtgcttgaagcagagcactcacacataaatggctgtgtgtggaattgcttgccaaagaagtttctagcctttccctttcccctaactgcatcagggaagaattcttatctctagcttggtttccacatgaggtttttctgagaagggcttgggacaagaagtctgtcatgttagttaagcaggcaagaaatcctactaatccagttttgtttgaaagttgtttgtccgtatgattttttaaaagtcaagtttaatttcaaaaaaccttttttttctgagattacttttggggtaatatttaaaatgagagacattttgtaaccctgtaaaatacatagggaatataacattccagtgtatacaaagaaggcaaattctttaatcaaataaagcgcattataaaatgagatgtttattggattattgactcactttggtgtctgcttgttgattcaggatgctgtaatgggacctaacattaaaaattaatgacatgttttttttaagagaaaaaaaaaaaaaaaaaaa

SEQ ID NO: 170 - protein, 511 aa, Homo sapiens
MVLLAAAVCTKAGKAIVSRQFVEMTRTRIEGLLAAFPKLMNTGKQHTFVETESVRYVYQPMEKLYMVLITTKNSNILEDLETLRLFSRVIPEYCRALEENEISEHCFDLIFAFDEIVALGYRENVNLAQIRTFTEMDSHEEKVFRAVRETQEREAKAEMRRKAKELQQARRDAERQGKKAPGFGGFGSSAVSGGSTAAMITETIIETDKPKVAPAPARPSGPSKALKLGAKGKEVDNFVDKLKSEGETIMSSSMGKRTSEATKMHAPPINMESVHMKIEEKITLTCGRDGGLQNMELHGMIMLRISDDKYGRIRLHVENEDKKGVQLQTHPNVDKKLFTAESLIGLKNPEKSFPVNSDVGVLKWRLQTTEESFIPLTINCWPSESGNGCDVNIEYELQEDNLELNDVVITIPLPSGVGAPVIGEIDGEYRHDSRRNTLEWCLPVIDAKNKSGSLEFSIAGQPNDFFPVQVSFVSKKNYCNIQVTKVTQVDGNSPVRFSTETTFLVDKYEIL

SEQ ID NO: 171 - DNA, 3768 bp, Homo sapiens
gaagacgtggcttggggccgccatcttggcaagaggcgaagcggcagcggttcctgtcaagggggcagcaggtccagagctgctggtgctcccgttccccagaccctacccctatccccagtggagccggagtgcgggcgcgccccaccaccgccctcaccatgatccctgaatattgccgagccttagaagagaatgaaatatctgagcactgttttgatttgatttttgcttttgatgaaattgtcgcactgggataccgggagaatgttaacttggcacagatcagaaccttcacagaaatggattctcatgaggagaaggtgttcagagccgtcagagagactcaagaacgtgaagctaaggctgagatgcgtcgtaaagcaaaggaattacaacaggcccgaagagatgcagagagacagggcaaaaaagcaccaggatttggcggatttggcagctctgcagtatctggaggcagcacagctgccatgatcacagagaccatcattgaaactgataaaccaaaagtggcacctgcaccagccaggccttcaggccccagcaaggctttaaaacttggagccaaaggaaaggaagtagataactttgtggacaaattaaaatctgaaggtgaaaccatcatgtcctctagtatgggcaagcgtacttctgaagcaaccaaaatgcatgctccacccattaatatggaaagtgtacatatgaagattgaagaaaagataacattaacctgtggacgagacggaggattacagaatatggagttgcatggcatgatcatgcttaggatctcagatgacaagtatggccgaattcgtcttcatgtggaaaatgaagataagaaaggggtgcagctacagacccatccaaatgtggataaaaaacttttcactgcagagtctctaattggcctgaagaatccagagaagtcatttccagtcaacagtgacgtaggggtgctaaagtggagactacaaaccacagaggaatcttttattccactgacaattaattgctggccctcggagagtggaaatggctgtgatgtcaacatagaatatgagctacaagaagataatttagaactgaatgatgtggttatcaccatcccactcccgtctggtgtcggcgcgcctgttatcggtgagatcgatggggagtatcgacatgacagtcgacgaaataccctggagtggtgcctgcctgtgattgatgccaaaaataagagtggcagcctggagtttagcattgctgggcagcccaatgacttcttccctgttcaagtttcctttgtctccaagaaaaattactgtaacatacaggttaccaaagtgacccaggtagatggaaacagccccgtcaggttttccacagagaccactttcctagtggataagtatgaaattctgtaataccaagaagagggagctgaaaaggaaaattttcagattaataaagaagacgccaatgatggctgaagagtttttcccagatttacaagccactggagaccccttttttctgatacaatgcacgattctctgcgcgcaaggaccctcgactcacccccatgtttcagtgtcacagagacattctttgataaggaaatggcacaaacataaagggaaaggctgctaattttctttggcagattgtattggccagcaggaaagcaagctctccagagaatgcccccagttaaatacctcctctacctttacctaagttgctcctttatttttattttattattattattattattattattattttttgagatggagtctcactttgtaacccaggctggaatgcaatggcatgatctcagctcactgcaacctccgcctcctgggttcaagcaagtctcctgcctcagcctccgagtagctgggactacaggtgcacgccaccacgcctggctaattttttgtattttagtagagacggggtttcaccgtgttgcccaggctggtcgcgaactcctgagctcaggcaatccgcccacctcagcctcccaaagtgttgggattacaggcatgagccaccatgcccagctgctcctttattttaatccctaaatataatccctaaatatagttatatttcatacttagtttgtttttaaaaagttttctctgtagaaaattttaatcattcataccctttacctttaggtttttctttctatacattcagtcaggcactgggatcatctgtttacaggcattatatttatttggcactcctggaacaagtatatctaacccattcttgatttttggactattcaggtgaactatttgaggggtatggggtctagaagttaaaagatacgcatgtcttctgttcttttcccgtatcaattcattccttcatctctttgccaagttgttttcctttcagggcctgtccttccagtttagaacagtaccatgaatcccacttgtgtcaatattaaagatagctgagaagcacctttcaaatggcacagtccctcttcaagatgtctaaaagaatggttatgtctgtccagttagggatttcacatccacatgtaatcatgtctgctgctgttgctacccaaattttcatttctccacattttgggtacttaagctaaaacgtaatggccacagtctgtaatccattcacattcctcagtttcaccacctccctcttccagactgcactctctgtcatcagtcccctcctttctaacagaaatggggttatgattttgaaggctgtgggttcagggagtctttgccaatcctgttggccctaaactatcaaggaggctccatttcaccatttgattttttgcatttcaggaggcaactgattgtttcgatatgtacatattactcacgtataccccatttccttccagtcagcccaacattttccaccagtctgtccccatctctgaaatccttccttctctttccccctaagtcttttgagtgtcatcatgtactggtggtttctcggttccatctcatccatttccttttcaatggagactacagcgtcagccagctcagccttggcttttaactcaatattccagtccataggggtggttaaaagttgctgcaaggctgcaggcactggcagtgggaagaggcagacgactagatgacttctgcacttttagctggttgaaaagtaccactcccactctgaacatctggccgtccctgcaaagagtgtactgtgcttgaagcagagcactcacacataaatggctgtgtgtggaattgcttgccaaagaagtttctagcctttccctttcccctaactgcatcagggaagaattcttatctctagcttggtttccacatgaggtttttctgagaagggcttgggacaagaagtctgtcatgttagttaagcaggcaagaaatcctactaatccagttttgtttgaaagttgtttgtccgtatgattttttaaaagtcaagtttaatttcaaaaaaccttttttttctgagattacttttggggtaatatttaaaatgagagacattttgtaaccctgtaaaatacatagggaatataacattccagtgtatacaaagaaggcaaattctttaatcaaataaagcgcattataaaatgagatgtttattggattattgactcactttggtgtctgcttgttgattcaggatgctgtaatgggacctaacattaaaaattaatgacatgttttttttaagagaaaaaaaaaaaaaaaaaaa

SEQ ID NO: 172 - protein, 423 aa, Homo sapiens
MIPEYCRALEENEISEHCFDLIFAFDEIVALGYRENVNLAQIRTFTEMDSHEEKVFRAVRETQEREAKAEMRRKAKELQQARRDAERQGKKAPGFGGFGSSAVSGGSTAAMITETIIETDKPKVAPAPARPSGPSKALKLGAKGKEVDNFVDKLKSEGETIMSSSMGKRTSEATKMHAPPINMESVHMKIEEKITLTCGRDGGLQNMELHGMIMLRISDDKYGRIRLHVENEDKKGVQLQTHPNVDKKLFTAESLIGLKNPEKSFPVNSDVGVLKWRLQTTEESFIPLTINCWPSESGNGCDVNIEYELQEDNLELNDVVITIPLPSGVGAPVIGEIDGEYRHDSRRNTLEWCLPVIDAKNKSGSLEFSIAGQPNDFFPVQVSFVSKKNYCNIQVTKVTQVDGNSPVRFSTETTFLVDKYEIL

SEQ ID NO: 173 - DNA, 3790 bp, Homo sapiens
gccgagctgcgcacgtgcggccggaagggaagtaacgtcagcctgagaactgagtagctgtactgtgtggcgccttattctaggcacttgttgggcagaatgtcacacctgccgatgaaactcctgcgtaagaagatcgagaagcggaacctcaaattgcggcagcggaacctaaagtttcagggggcctcaaatctgaccctatcggaaactcaaaatggagatgtatctgaagaaacaatgggaagtagaaaggttaaaaaatcaaaacaaaagcccatgaatgtgggcttatcagaaactcaaaatggaggcatgtctcaagaagcagtgggaaatataaaagttacaaagtctccccagaaatccactgtattaaccaatggagaagcagcaatgcagtcttccaattcagaatcaaaaaagaaaaagaagaaaaagagaaaaatggtgaatgatgctgagcctgatacgaaaaaagcaaaaactgaaaacaaagggaaatctgaagaagaaagtgccgagactactaaagaaacagaaaataatgtggagaagccagataatgatgaagatgagagtgaggtgcccagtctgcccctgggactgacaggagcttttgaggatacttcgtttgcttctctatgtaatcttgtcaatgaaaacactctgaaggcaataaaagaaatgggttttacaaacatgactgaaattcagcataaaagtatcagaccacttctggaaggcagggatcttctagcagctgcaaaaacaggcagtggtaaaaccctggcttttctcatccctgcagttgaactcattgttaagttaaggttcatgcccaggaatggaacaggagtccttattctctcacctactagagaactagccatgcaaacctttggtgttcttaaggagctgatgactcaccacgtgcatacctatggcttgataatgggtggcagtaacagatctgctgaagcacagaaacttggtaatgggatcaacatcattgtggccacaccaggccgtctgctggaccatatgcagaataccccaggatttatgtataaaaacctgcagtgtctggttattgatgaagctgatcgtatcttggatgtggggtttgaagaggaattaaagcaaattattaaacttttgccaacacgtagacagactatgctcttttctgccacccaaactcgaaaagttgaagacctggcaaggatttctctgaaaaaggagccattgtatgttggcgttgatgatgataaagcgaatgcaacagtggatggtcttgaacagggatatgttgtttgtccttctgaaaagagattccttctgctctttacattccttaagaagaaccgaaagaagaagcttatggtcttcttttcatcttgtatgtctgtgaaataccactatgagttgctgaactacattgatttgcccgtcttggccattcatggaaagcaaaagcaaaataagcgtacaaccacattcttccagttctgcaatgcagattcgggaacactattgtgtacggatgtggcagcgagaggactagacattcctgaagtcgactggattgttcagtatgaccctccggatgaccctaaggaatatattcatcgtgtgggtagaacagccagaggcctaaatgggagagggcatgccttgctcattttgcgcccagaagaattgggttttcttcgctacttgaaacaatccaaggttccattaagtgaatttgacttttcctggtctaaaatttctgacattcagtctcagcttgagaaattgattgaaaagaattactttcttcataagtcagcccaggaagcatataagtcatacatacgagcctatgattcccattctctgaaacagatctttaatgttaataacctaaatttgcctcaggttgctctgtcatttggtttcaaggtgcctcccttcgttgatctgaacgtcaacagtaatgaaggcaagcagaaaaagcgaggaggtggtggtggatttggctaccagaaaaccaagaaagttgagaaatccaaaatctttaaacacattagcaagaaatcatctgacagcaggcagttctctcactgaacacatgccttcctttcatcttgaataactttgtcctaaaatgaattttttttccccttgatttaacaggatttttgtagactttagaatttggacttacctaacaagagtataaattgacttgggttgcaagcactgagcactgttacttctatcacgtctctcttttatttctgggatataaaacaggctttaagtttcttggttgcccaagggcagagcaaggaatatctggtgtttcttgtgatgataatattttaattttaaatatccctccctcatacaagtgtatgttaccattttaatataattctttttgtacctttccttcttgttttgcgaagatttttgtggcatggattgctgtgctcactgctgtaaaaggtgacctagtgtactgggcagctggtggcggtgcagaaaagagtctcaggttattttttgtttttagttatttcttggaccttgacagtatctaatgactcctcctgaaaatgctgcagtataaaagagcaaagagctttgggaaatacctaagaagcaccttaagattagggtggcattgcttttatagattcttgattttaaagcaacaggcctttctcaggtgttgcattttttggagcaaaaactatgggttgtaatttgaataaagtgtcactaagcagttataacgtttgatggctggggggtaggaagaggatggaattgagatgtttgagcctcatttacatcaatagaggtgtaatgtactgcatttcttcatttggtaacataacaaagactttcatacaaagaacgatgatgctcctcattaagatttgtttaattcaaggtggtttggatttggtaagcctttgcactctgtagagtacttagaagacaagggcaacttacttggagttagagccaagctgtcagacggtgcccagcacacattaatgttagcttctttctgagaaaaaaatacctcttccaggccctgaaacaaaaaatacatttgctgtgaagattgaaaatgaacaaagttagaaaaaaaaacagcaaaatcagtgatttagtcagatgagtttttcgttgtaggagcacttgatttctagtgtgttttgtacagtatataactacaagatagtacattttgtagcagttcaaagccaaagttgctagcatcattttgctgttgtgccagttaatcataggatcccattaaataagtgtgctaacatcgaatatagagaaaactggtaaagaacattccagtaggaaaagaaaagaacaatcttccatttctgggcttggccaccatcaccctggtcggacctgtcctggacttccaaccttgactgctgagctcctggcttagcttcttgggttcctaattcctggtgtttaataattctctccacgatcatgtttttctgattttttttttcagaaataatgttttttaaaagacaaaaacaaagggaagaatatttaattactgagcagaagtaaatactgttggcattttgtacataatctaatttttatatgcatgttcatgctttttaatttttttatcaaaaattaagtcatctacctactacttgtaaccagcttgtttcataacatgttattttcctgtgtcattaaataattacttcaatgttgaaaaaaaaaaaaaaaaaaaaaaaaa

SEQ ID NO: 174 - protein, 670 aa, Homo sapiens
MSHLPMKLLRKKIEKRNLKLRQRNLKFQGASNLTLSETQNGDVSEETMGSRKVKKSKQKPMNVGLSETQNGGMSQEAVGNIKVTKSPQKSTVLTNGEAAMQSSNSESKKKKKKKRKMVNDAEPDTKKAKTENKGKSEEESAETTKETENNVEKPDNDEDESEVPSLPLGLTGAFEDTSFASLCNLVNENTLKAIKEMGFTNMTEIQHKSIRPLLEGRDLLAAAKTGSGKTLAFLIPAVELIVKLRFMPRNGTGVLILSPTRELAMQTFGVLKELMTHHVHTYGLIMGGSNRSAEAQKLGNGINIIVATPGRLLDHMQNTPGFMYKNLQCLVIDEADRILDVGFEEELKQIIKLLPTRRQTMLFSATQTRKVEDLARISLKKEPLYVGVDDDKANATVDGLEQGYVVCPSEKRFLLLFTFLKKNRKKKLMVFFSSCMSVKYHYELLNYIDLPVLAIHGKQKQNKRTTTFFQFCNADSGTLLCTDVAARGLDIPEVDWIVQYDPPDDPKEYIHRVGRTARGLNGRGHALLILRPEELGFLRYLKQSKVPLSEFDFSWSKISDIQSQLEKLIEKNYFLHKSAQEAYKSYIRAYDSHSLKQIFNVNNLNLPQVALSFGFKVPPFVDLNVNSNEGKQKKRGGGGGFGYQKTKKVEKSKIFKHISKKSSDSRQFSH

SEQ ID NO: 175 - DNA, 4410 bp, Homo sapiens
gtgctcgggggttccctggccctttcggcaggggtaaaacaataagagggggcggtggcaaagggggcgggacgtccgtggtccttgtcgcacgtcgcagcgcctggcgcccgggaagaggtggttgtgaggcagacgaactcgcggctctccggcttccgaggcttccgagttgtcggaggaagggggcggcgagcaataagaacccgccgcacccggtcctcagcgactcttctgacctccgcgcgacgtacccgccgccgccgttggctggagcatttgacattgtgcagcaaagaaatggttatggagaagcccagtccgctgcttgtagggcgggagtttgtgaggcaatattatactttgctgaataaagctccggaatatttacacaggttttatggcaggaattcttcctatgttcatggtggagtagatgctagtggaaagccccaggaagctgtttatggccaaaatgatatacaccacaaagtattatctctgaacttcagtgaatgtcatactaaaattcgtcatgtggatgctcatgcaaccttgagtgatggagtagttgtccaggtcatgggtttgctgtctaacagtggacaaccagaaagaaagtttatgcaaacctttgttctggctcctgaaggatctgttccaaataaattttatgttcacaatgatatgtttcgttatgaagatgaagtgtttggtgattctgagcctgaacttgatgaagaatcagaagatgaagtagaagaggaacaagaagaaagacaaccatctcctgaacctgtgcaagaaaatgctaacagtggttactatgaagctcaccctgtgactaatggcatagaggagcctttggaagaatcctctcatgaacctgaacctgagccagaatctgaaacaaagactgaagagctgaaaccacaagtggaggagaagaacttagaagaactagaggagaaatctactactcctcctccggcagaacctgtttctctgccacaagaaccaccaaaggctttctcctgggcttcagtgaccagtaaaaacctgcctcctagtggtactgtttcttcctctggaattccaccccatgttaaagcaccagtctcacagccaagagtcgaagctaaaccagaagttcaatctcagccacctcgtgtgcgtgaacaacgacctagagaacgacctggttttcctcctagaggaccaagaccaggcagaggagatatggaacagaatgactctgacaaccgtagaataattcgctatccagatagtcatcaactttttgttggtaacttgccacatgatattgatgaaaatgagctaaaggaattcttcatgagttttggaaacgttgtggaacttcgcatcaataccaagggtgttgggggaaagcttccaaattttggttttgtggtttttgatgactctgaaccagttcagagaatcttaattgcaaaaccgattatgtttcgaggggaagtacgtttaaatgtggaagagaaaaaaacaagagctgcaagagagcgagaaaccagaggtggtggtgatgatcgcagggatattaggcgcaatgatcgaggtcccggtggtccacgtggaattgtgggtggtggaatgatgcgtgatcgtgatggaagaggacctcctccaaggggtggcatggcacagaaacttggctctggaagaggaaccgggcaaatggagggccgcttcacaggacagcgtcgctgaagctccactgttggcaaagtcttggcagtggtacattattcatcgtgtttgcattcttgttaattttttttttggctttggaatgtgacacagcctttttgatcatttctttgatgtgaaaagcatctttggttatcagttaaattgaggtggacattatttccccaatttcacaacaggattcacattgttaatttataaatctagacttggagaattaaggactgagaaatgaccatatcttaaactatctacgacaaagtgaacttaaaaggacatgcccactgaattcaggtcctttgagtaaaaaaaaaatcttctgctgcacattttgtttaagtgttactgtttctgcctgttaatgctgggaacacaaatagtgcaatttgtgcaattggagaatcttgccttttttcttggctccccccaaaaatacaaaccaacagaaacttgttatgcactcatcaaaatgtactaatgggtactctgaactcattaacattgacatctgcaacaggaggcaacagggaaaaaatctcatcttcttttccagtagaaaatagtttgtgaaatgatgagggcattttatctgcttgctgtgaccagcgtgtgtacacataaaccttaacaagactacaagtatattccagaaggaaatcattttagttatgaactaaataataaaaattagaacttcaaatgcgatggtcttgactattagaccagatttagtagctccatatctaagatttttctacctgcccctcttcagtacagggatggctggctgctcaacacactcctcctccccttttttcctttctttaagctgtgtacagtgaaaattgtctttactgtatttttgttctctggtaatgtaataagcatgatggtgccttctattaatacatcattccagtcttgctggtaattttgtacagtatagtgtatgaattgctgtgctgcaaagccaaacagctgcaaaatgttgaaaaatcatcgaaatgtataaaaattgcagtatctttaaaatcagtaaaatggactagcatattatttatcttgttcttcagttaacaactttgtgttctctgtgggagggagggagtcctgtgtgtttgtggggagagggaaggaggaagtcagttatttgagtaagcctctagttgacttttctcttagcctgaatgtggacgttgaaacatatcacttcagggcttggaaaagtcagtcaacttgacgtacatttttagtgacattttaaaagcagtcagattctataaatggcaagtaagcctgaagtgaggatactgcaattttcggagaaaagaacagcagctctttaagtgtttgcattttctatttggggggcagggaactgtcattcattttgcacaattcttgaactgatgtcagcacccgagtggctcctgaatttaagtctgggacgacatcttttatttttacatgaatctttaaacaattctgtgagcaaagtttgtagctgctggattattgtctgtctttatagcaagttccagtaaaccacaagtatggcaaagcttatccaattttatgcttggagcagtcagtacataccagtttctgatgtttcaggcaggagtggggtaaataagtgtgaccacttaaagctgctcgttagcatggaagacttctccattctatctttgtaaaacagacaagatatgcacttgacatagtagcaaattggttctgaattatgcaactgtttgctatttagtaaactagcaaatgatgcatgtattttgtttttcatgtactgggcaatatgagtaaaatctgtccctttttccccctttgaatgaggtcttccatgtttgagggaaagtcttgcactattgcatatattttggggacacagattttcatagtttccatttttggggggcttaaggattttttttttttctgtttgaaacagttttatactttctgatatagtacttgaaattcttaccagaaaattactttggagttttgaagcctttattaatactacttttaaagaagcagttgttttattgtcaatgttttttttcccccaagcatattttcttgtatttctgtttccatatatatatatatatatataatttccaattcaggatattgccctgccatccatgaaaactgttctggcaccaaaagtaatgacaaatgttaagtgtaataatagaaaagtagagcaaagagccattcagcttcagtctttacataccatgaataaaacattaaaacatcatatggagaagtttacatggtgattgttcacctgcagtactgtggagttttaacattttgtcctcttttcagtgaaacagagtaaaaatattcatctaccattactgttatttgctgattttgttttattttttgatggtaatattctatccttatgacactattgcaaccaaattggctttaccatcttggctttagtaggtatagaagacaatggattaccatctttattgctgtaatgtgttaagcattatatgctagtagaatctagtttaattgtttcaggtggaaagtattctttgagtttccatattgaatgtgtttggactaaacaaacaataaactactgatgtctgcagcatttatctatgtccctaa

SEQ ID NO: 176 - protein, 482 aa, Homo sapiens
MVMEKPSPLLVGREFVRQYYTLLNKAPEYLHRFYGRNSSYVHGGVDASGKPQEAVYGQNDIHHKVLSLNFSECHTKIRHVDAHATLSDGVVVQVMGLLSNSGQPERKFMQTFVLAPEGSVPNKFYVHNDMFRYEDEVFGDSEPELDEESEDEVEEEQEERQPSPEPVQENANSGYYEAHPVTNGIEEPLEESSHEPEPEPESETKTEELKPQVEEKNLEELEEKSTTPPPAEPVSLPQEPPKAFSWASVTSKNLPPSGTVSSSGIPPHVKAPVSQPRVEAKPEVQSQPPRVREQRPRERPGFPPRGPRPGRGDMEQNDSDNRRIIRYPDSHQLFVGNLPHDIDENELKEFFMSFGNVVELRINTKGVGGKLPNFGFVVFDDSEPVQRILIAKPIMFRGEVRLNVEEKKTRAARERETRGGGDDRRDIRRNDRGPGGPRGIVGGGMMRDRDGRGPPPRGGMAQKLGSGRGTGQMEGRFTGQRR

SEQ ID NO: 177 - DNA, 4275 bp, Homo sapiens
acattccattcgcgctccgcggcgcgaggcaatcgtccggtgtgtgagcccgggagccggaggtgtagcggcagagacattgttcttgccggctccctacggtgccgtgtgtgcgtgagagaagaccagtctttcctctagcatttgacattgtgcagcaaagaaatggttatggagaagcccagtccgctgcttgtagggcgggagtttgtgaggcaatattatactttgctgaataaagctccggaatatttacacaggttttatggcaggaattcttcctatgttcatggtggagtagatgctagtggaaagccccaggaagctgtttatggccaaaatgatatacaccacaaagtattatctctgaacttcagtgaatgtcatactaaaattcgtcatgtggatgctcatgcaaccttgagtgatggagtagttgtccaggtcatgggtttgctgtctaacagtggacaaccagaaagaaagtttatgcaaacctttgttctggctcctgaaggatctgttccaaataaattttatgttcacaatgatatgtttcgttatgaagatgaagtgtttggtgattctgagcctgaacttgatgaagaatcagaagatgaagtagaagaggaacaagaagaaagacaaccatctcctgaacctgtgcaagaaaatgctaacagtggttactatgaagctcaccctgtgactaatggcatagaggagcctttggaagaatcctctcatgaacctgaacctgagccagaatctgaaacaaagactgaagagctgaaaccacaagtggaggagaagaacttagaagaactagaggagaaatctactactcctcctccggcagaacctgtttctctgccacaagaaccaccaaaggctttctcctgggcttcagtgaccagtaaaaacctgcctcctagtggtactgtttcttcctctggaattccaccccatgttaaagcaccagtctcacagccaagagtcgaagctaaaccagaagttcaatctcagccacctcgtgtgcgtgaacaacgacctagagaacgacctggttttcctcctagaggaccaagaccaggcagaggagatatggaacagaatgactctgacaaccgtagaataattcgctatccagatagtcatcaactttttgttggtaacttgccacatgatattgatgaaaatgagctaaaggaattcttcatgagttttggaaacgttgtggaacttcgcatcaataccaagggtgttgggggaaagcttccaaattttggttttgtggtttttgatgactctgaaccagttcagagaatcttaattgcaaaaccgattatgtttcgaggggaagtacgtttaaatgtggaagagaaaaaaacaagagctgcaagagagcgagaaaccagaggtggtggtgatgatcgcagggatattaggcgcaatgatcgaggtcccggtggtccacgtggaattgtgggtggtggaatgatgcgtgatcgtgatggaagaggacctcctccaaggggtggcatggcacagaaacttggctctggaagaggaaccgggcaaatggagggccgcttcacaggacagcgtcgctgaagctccactgttggcaaagtcttggcagtggtacattattcatcgtgtttgcattcttgttaattttttttttggctttggaatgtgacacagcctttttgatcatttctttgatgtgaaaagcatctttggttatcagttaaattgaggtggacattatttccccaatttcacaacaggattcacattgttaatttataaatctagacttggagaattaaggactgagaaatgaccatatcttaaactatctacgacaaagtgaacttaaaaggacatgcccactgaattcaggtcctttgagtaaaaaaaaaatcttctgctgcacattttgtttaagtgttactgtttctgcctgttaatgctgggaacacaaatagtgcaatttgtgcaattggagaatcttgccttttttcttggctccccccaaaaatacaaaccaacagaaacttgttatgcactcatcaaaatgtactaatgggtactctgaactcattaacattgacatctgcaacaggaggcaacagggaaaaaatctcatcttcttttccagtagaaaatagtttgtgaaatgatgagggcattttatctgcttgctgtgaccagcgtgtgtacacataaaccttaacaagactacaagtatattccagaaggaaatcattttagttatgaactaaataataaaaattagaacttcaaatgcgatggtcttgactattagaccagatttagtagctccatatctaagatttttctacctgcccctcttcagtacagggatggctggctgctcaacacactcctcctccccttttttcctttctttaagctgtgtacagtgaaaattgtctttactgtatttttgttctctggtaatgtaataagcatgatggtgccttctattaatacatcattccagtcttgctggtaattttgtacagtatagtgtatgaattgctgtgctgcaaagccaaacagctgcaaaatgttgaaaaatcatcgaaatgtataaaaattgcagtatctttaaaatcagtaaaatggactagcatattatttatcttgttcttcagttaacaactttgtgttctctgtgggagggagggagtcctgtgtgtttgtggggagagggaaggaggaagtcagttatttgagtaagcctctagttgacttttctcttagcctgaatgtggacgttgaaacatatcacttcagggcttggaaaagtcagtcaacttgacgtacatttttagtgacattttaaaagcagtcagattctataaatggcaagtaagcctgaagtgaggatactgcaattttcggagaaaagaacagcagctctttaagtgtttgcattttctatttggggggcagggaactgtcattcattttgcacaattcttgaactgatgtcagcacccgagtggctcctgaatttaagtctgggacgacatcttttatttttacatgaatctttaaacaattctgtgagcaaagtttgtagctgctggattattgtctgtctttatagcaagttccagtaaaccacaagtatggcaaagcttatccaattttatgcttggagcagtcagtacataccagtttctgatgtttcaggcaggagtggggtaaataagtgtgaccacttaaagctgctcgttagcatggaagacttctccattctatctttgtaaaacagacaagatatgcacttgacatagtagcaaattggttctgaattatgcaactgtttgctatttagtaaactagcaaatgatgcatgtattttgtttttcatgtactgggcaatatgagtaaaatctgtccctttttccccctttgaatgaggtcttccatgtttgagggaaagtcttgcactattgcatatattttggggacacagattttcatagtttccatttttggggggcttaaggattttttttttttctgtttgaaacagttttatactttctgatatagtacttgaaattcttaccagaaaattactttggagttttgaagcctttattaatactacttttaaagaagcagttgttttattgtcaatgttttttttcccccaagcatattttcttgtatttctgtttccatatatatatatatatatataatttccaattcaggatattgccctgccatccatgaaaactgttctggcaccaaaagtaatgacaaatgttaagtgtaataatagaaaagtagagcaaagagccattcagcttcagtctttacataccatgaataaaacattaaaacatcatatggagaagtttacatggtgattgttcacctgcagtactgtggagttttaacattttgtcctcttttcagtgaaacagagtaaaaatattcatctaccattactgttatttgctgattttgttttattttttgatggtaatattctatccttatgacactattgcaaccaaattggctttaccatcttggctttagtaggtatagaagacaatggattaccatctttattgctgtaatgtgttaagcattatatgctagtagaatctagtttaattgtttcaggtggaaagtattctttgagtttccatattgaatgtgtttggactaaacaaacaataaactactgatgtctgcagcatttatctatgtccctaa

SEQ ID NO: 178 - protein, 482 aa, Homo sapiens; identical to SEQ ID NO: 176

SEQ ID NO: 179 - DNA, 4311 bp, Homo sapiens
gtgctcgggggttccctggccctttcggcaggggtaaaacaataagagggggcggtggcaaagggggcgggacgtccgtggtccttgtcgcacgtcgcagcgcctggcgcccgggaagaggtggttgtgaggcagacgaactcgcggctctccggcttccgaggcttccgagttgtcggaggaagggggcggcgagcaataagaacccgccgcacccggtcctcagcgactcttctgacctccgcgcgacgtacccgccgccgccgttggctggagcatttgacattgtgcagcaaagaaatggttatggagaagcccagtccgctgcttgtagggcgggagtttgtgaggcaatattatactttgctgaataaagctccggaatatttacacaggttttatggcaggaattcttcctatgttcatggtggagtagatgctagtggaaagccccaggaagctgtttatggccaaaatgatatacaccacaaagtattatctctgaacttcagtgaatgtcatactaaaattcgtcatgtggatgctcatgcaaccttgagtgatggagtagttgtccaggtcatgggtttgctgtctaacagtggacaaccagaaagaaagtttatgcaaacctttgttctggctcctgaaggatctgttccaaataaattttatgttcacaatgatatgtttcgttatgaagatgaagtgtttggtgattctgagcctgaacttgatgaagaatcagaagatgaagtagaagaggaacaagaagaaagacaaccatctcctgaacctgtgcaagaaaatgctaacagtggttactatgaagctcaccctgtgactaatggcatagaggagcctttggaagaatcctctcatgaacctgaacctgagccagaatctgaaacaaagactgaagagctgaaaccacaagtggaggagaagaacttagaagaactagaggagaaatctactactcctcctccggcagaacctgtttctctgccacaagaaccaccaaagccaagagtcgaagctaaaccagaagttcaatctcagccacctcgtgtgcgtgaacaacgacctagagaacgacctggttttcctcctagaggaccaagaccaggcagaggagatatggaacagaatgactctgacaaccgtagaataattcgctatccagatagtcatcaactttttgttggtaacttgccacatgatattgatgaaaatgagctaaaggaattcttcatgagttttggaaacgttgtggaacttcgcatcaataccaagggtgttgggggaaagcttccaaattttggttttgtggtttttgatgactctgaaccagttcagagaatcttaattgcaaaaccgattatgtttcgaggggaagtacgtttaaatgtggaagagaaaaaaacaagagctgcaagagagcgagaaaccagaggtggtggtgatgatcgcagggatattaggcgcaatgatcgaggtcccggtggtccacgtggaattgtgggtggtggaatgatgcgtgatcgtgatggaagaggacctcctccaaggggtggcatggcacagaaacttggctctggaagaggaaccgggcaaatggagggccgcttcacaggacagcgtcgctgaagctccactgttggcaaagtcttggcagtggtacattattcatcgtgtttgcattcttgttaattttttttttggctttggaatgtgacacagcctttttgatcatttctttgatgtgaaaagcatctttggttatcagttaaattgaggtggacattatttccccaatttcacaacaggattcacattgttaatttataaatctagacttggagaattaaggactgagaaatgaccatatcttaaactatctacgacaaagtgaacttaaaaggacatgcccactgaattcaggtcctttgagtaaaaaaaaaatcttctgctgcacattttgtttaagtgttactgtttctgcctgttaatgctgggaacacaaatagtgcaatttgtgcaattggagaatcttgccttttttcttggctccccccaaaaatacaaaccaacagaaacttgttatgcactcatcaaaatgtactaatgggtactctgaactcattaacattgacatctgcaacaggaggcaacagggaaaaaatctcatcttcttttccagtagaaaatagtttgtgaaatgatgagggcattttatctgcttgctgtgaccagcgtgtgtacacataaaccttaacaagactacaagtatattccagaaggaaatcattttagttatgaactaaataataaaaattagaacttcaaatgcgatggtcttgactattagaccagatttagtagctccatatctaagatttttctacctgcccctcttcagtacagggatggctggctgctcaacacactcctcctccccttttttcctttctttaagctgtgtacagtgaaaattgtctttactgtatttttgttctctggtaatgtaataagcatgatggtgccttctattaatacatcattccagtcttgctggtaattttgtacagtatagtgtatgaattgctgtgctgcaaagccaaacagctgcaaaatgttgaaaaatcatcgaaatgtataaaaattgcagtatctttaaaatcagtaaaatggactagcatattatttatcttgttcttcagttaacaactttgtgttctctgtgggagggagggagtcctgtgtgtttgtggggagagggaaggaggaagtcagttatttgagtaagcctctagttgacttttctcttagcctgaatgtggacgttgaaacatatcacttcagggcttggaaaagtcagtcaacttgacgtacatttttagtgacattttaaaagcagtcagattctataaatggcaagtaagcctgaagtgaggatactgcaattttcggagaaaagaacagcagctctttaagtgtttgcattttctatttggggggcagggaactgtcattcattttgcacaattcttgaactgatgtcagcacccgagtggctcctgaatttaagtctgggacgacatcttttatttttacatgaatctttaaacaattctgtgagcaaagtttgtagctgctggattattgtctgtctttatagcaagttccagtaaaccacaagtatggcaaagcttatccaattttatgcttggagcagtcagtacataccagtttctgatgtttcaggcaggagtggggtaaataagtgtgaccacttaaagctgctcgttagcatggaagacttctccattctatctttgtaaaacagacaagatatgcacttgacatagtagcaaattggttctgaattatgcaactgtttgctatttagtaaactagcaaatgatgcatgtattttgtttttcatgtactgggcaatatgagtaaaatctgtccctttttccccctttgaatgaggtcttccatgtttgagggaaagtcttgcactattgcatatattttggggacacagattttcatagtttccatttttggggggcttaaggattttttttttttctgtttgaaacagttttatactttctgatatagtacttgaaattcttaccagaaaattactttggagttttgaagcctttattaatactacttttaaagaagcagttgttttattgtcaatgttttttttcccccaagcatattttcttgtatttctgtttccatatatatatatatatatataatttccaattcaggatattgccctgccatccatgaaaactgttctggcaccaaaagtaatgacaaatgttaagtgtaataatagaaaagtagagcaaagagccattcagcttcagtctttacataccatgaataaaacattaaaacatcatatggagaagtttacatggtgattgttcacctgcagtactgtggagttttaacattttgtcctcttttcagtgaaacagagtaaaaatattcatctaccattactgttatttgctgattttgttttattttttgatggtaatattctatccttatgacactattgcaaccaaattggctttaccatcttggctttagtaggtatagaagacaatggattaccatctttattgctgtaatgtgttaagcattatatgctagtagaatctagtttaattgtttcaggtggaaagtattctttgagtttccatattgaatgtgtttggactaaacaaacaataaactactgatgtctgcagcatttatctatgtccctaa

SEQ ID NO: 180 - protein, 449 aa, Homo sapiens
MVMEKPSPLLVGREFVRQYYTLLNKAPEYLHRFYGRNSSYVHGGVDASGKPQEAVYGQNDIHHKVLSLNFSECHTKIRHVDAHATLSDGVVVQVMGLLSNSGQPERKFMQTFVLAPEGSVPNKFYVHNDMFRYEDEVFGDSEPELDEESEDEVEEEQEERQPSPEPVQENANSGYYEAHPVTNGIEEPLEESSHEPEPEPESETKTEELKPQVEEKNLEELEEKSTTPPPAEPVSLPQEPPKPRVEAKPEVQSQPPRVREQRPRERPGFPPRGPRPGRGDMEQNDSDNRRIIRYPDSHQLFVGNLPHDIDENELKEFFMSFGNVVELRINTKGVGGKLPNFGFVVFDDSEPVQRILIAKPIMFRGEVRLNVEEKKTRAARERETRGGGDDRRDIRRNDRGPGGPRGIVGGGMMRDRDGRGPPPRGGMAQKLGSGRGTGQMEGRFTGQRR

SEQ ID NO: 181 - DNA, 546 bp, Homo sapiens
ctgaactgggttaggtgccgctgttgctgctcgtgttgaatctagaaccgtagccagacatgggactggaggacgagcaaaagatgcttaccgaatccggagatcctgaggaggaggaagaggaagaggaggaattagtggatcccctaacaacagtgagagagcaatgcgagcagttggagaaatgtgtaaaggcccgggagcggctagagctctgtgatgagcgtgtatcctctcgatcacatacagaagaggattgcacggaggagctctttgacttcttgcatgcgagggaccattgcgtggcccacaaactctttaacaacttgaaataaatgtgtggacttaattcaccccagtcttcatcatctgggcatcagaatatttccttatggttttggatgtaccatttgtttcttatttgtgtaactgtaagttcacatgaacctcatgggtttggcttaggctggtagcttctatgtaattcgcaatgattccatctaaataaaagttctatgatctgcaaaaaaaaaaaaaaaaaaaaaa

SEQ ID NO: 182 - protein, 91 aa, Homo sapiens
MGLEDEQKMLTESGDPEEEEEEEEELVDPLTTVREQCEQLEKCVKARERLELCDERVSSRSHTEEDCTEELFDFLHARDHCVAHKLFNNLK

SEQ ID NO: 183 - DNA, 3385 bp, Homo sapiens
gctctggtgctgcggctccgctctcgtcgcaacgagatctttcgagatcttctccgcccccgctaccggcgcctcctctgcggccactgagccggagccggcctgagcagcgctctcggttgcagtacccactggaaggacttaggcgctcgcgtggacaccgcaagcccctcagtagcctcggcccaagaggcctgctttccactcgctagccccgccgggggtccgtgtcctgtctcggtggccggacccgggcccgagcccgagcagtagccggcgccatgtcggtggtgggcatagacctgggcttccagagctgctacgtcgctgtggcccgcgccggcggcatcgagactatcgctaatgagtatagcgaccgctgcacgccggcttgcatttcttttggtcctaagaatcgttcaattggagcagcagctaaaagccaggtaatttctaatgcaaagaacacagtccaaggatttaaaagattccatggccgagcattctctgatccatttgtggaggcagaaaaatctaaccttgcatatgatattgtgcagttgcctacaggattaacaggtataaaggtgacatatatggaggaagagcgaaattttaccactgagcaagtgactgccatgcttttgtccaaactgaaggagacagccgaaagtgttcttaagaagcctgtagttgactgtgttgtttcggttccttgtttctatactgatgcagaaagacgatcagtgatggatgcaacacagattgctggtcttaattgcttgcgattaatgaatgaaaccactgcagttgctcttgcatatggaatctataagcaggatcttcctgccttagaagagaaaccaagaaatgtagtttttgtagacatgggccactctgcttatcaagtttctgtatgtgcatttaatagaggaaaactgaaagttctggccactgcatttgacacgacattgggaggtagaaaatttgatgaagtgttagtaaatcacttctgtgaagaatttgggaagaaatacaagctagacattaagtccaaaatccgtgcattattacgactctctcaggagtgtgagaaactcaagaaattgatgagtgcaaatgcttcagatctccctttgagcattgaatgttttatgaatgatgttgatgtatctggaactatgaatagaggcaaatttctggagatgtgcaatgatctcttagctagagtggagccaccacttcgtagtgttttggaacaaaccaagttaaagaaagaagatatttatgcagtggagatagttggtggtgctacacgaatccctgcggtaaaagagaagatcagcaaatttttcggtaaagaacttagtacaacattaaatgctgatgaagctgtcactcgaggctgtgcattgcagtgtgccatcttatcgcctgctttcaaagtcagagaattttctatcactgatgtagtaccatatccaatatctctgagatggaattctccagctgaagaagggtcaagtgactgtgaagtcttttccaaaaatcatgctgctcctttctctaaagttcttacattttatagaaaggaacctttcactcttgaggcctactacagctctcctcaggatttgccctatccagatcctgctatagctcagttttcagttcagaaagtcactcctcagtctgatggctccagttcaaaagtgaaagtcaaagttcgagtaaatgtccatggcattttcagtgtgtccagtgcatctttagtggaggttcacaagtctgaggaaaatgaggagccaatggaaacagatcagaatgcaaaggaggaagagaagatgcaagtggaccaggaggaaccacatgttgaagagcaacagcagcagacaccagcagaaaataaggcagagtctgaagaaatggagacctctcaagctggatccaaggataaaaagatggaccaaccaccccaagccaagaaggcaaaagtgaagaccagtactgtggacctgccaatcgagaatcagctattatggcagatagacagagagatgctcaacttgtacattgaaaatgagggtaagatgatcatgcaggataaactggagaaggagcggaatgatgctaagaacgcagtggaggaatatgtgtatgaaatgagagacaagcttagtggtgaatatgagaagtttgtgagtgaagatgatcgtaacagttttactttgaaactggaagatactgaaaattggttgtatgaggatggagaagaccagccaaagcaagtttatgttgataagttggctgaattaaaaaatctaggtcaacctattaagatacgtttccaggaatctgaagaacgaccaaaattatttgaagaactagggaaacagatccaacagtatatgaaaataatcagctctttcaaaaacaaggaggaccagtatgatcatttggatgctgctgacatgacaaaggtagaaaaaagcacaaatgaagcaatggagtggatgaataacaagctaaatctgcagaacaagcagagtttgaccatggatccagttgtcaagtcaaaagagattgaagctaaaattaaggagctgacaagtacttgtagccctataatttcaaagcccaaacccaaagtggaacctccaaaagaggaacaaaaaaatgcagagcagaatggaccagtggatggacaaggagacaacccaggcccccaggctgctgagcagggtacagacacagctgtgccttcggattcagacaagaagcttcctgaaatggacattgattgattccaacacttgtttctattaaaacagactattataaagctttaagttgtcaactttgttctaaatatcaactagcgcaagtgaatactgaagatttcttagtcagtttttaggggattttcggggaggggaaataggtaatgtatggagcattttcacttctaaatagttagatacagaaattaagtgcattgtatctttttcataatggtactatttagaagcccagttagtcttactgagcttatgcttcactcctttatgtttaaccatgtgtctacaagaataagtttgttttggaaagttgagctatagctacagctctagctatccagcagacttttcattatgacttacatggcaggagctctaattatgctttaaaaatctgttgtggagattgctttaaatgctccctgcctggtgtggggatggggtccccctctttgtgagggctggagcatggcacggcatggattaacacggcagaggaacaaaggtgtgctctgagcttcttcatatttcaccttcaccctcacctgtgttctcttccctctctcccaataaaagggctcccatta

SEQ ID NO: 184 - protein, 840 aa, Homo sapiens
MSVVGIDLGFQSCYVAVARAGGIETIANEYSDRCTPACISFGPKNRSIGAAAKSQVISNAKNTVQGFKRFHGRAFSDPFVEAEKSNLAYDIVQLPTGLTGIKVTYMEEERNFTTEQVTAMLLSKLKETAESVLKKPVVDCVVSVPCFYTDAERRSVMDATQIAGLNCLRLMNETTAVALAYGIYKQDLPALEEKPRNVVFVDMGHSAYQVSVCAFNRGKLKVLATAFDTTLGGRKFDEVLVNHFCEEFGKKYKLDIKSKIRALLRLSQECEKLKKLMSANASDLPLSIECFMNDVDVSGTMNRGKFLEMCNDLLARVEPPLRSVLEQTKLKKEDIYAVEIVGGATRIPAVKEKISKFFGKELSTTLNADEAVTRGCALQCAILSPAFKVREFSITDVVPYPISLRWNSPAEEGSSDCEVFSKNHAAPFSKVLTFYRKEPFTLEAYYSSPQDLPYPDPAIAQFSVQKVTPQSDGSSSKVKVKVRVNVHGIFSVSSASLVEVHKSEENEEPMETDQNAKEEEKMQVDQEEPHVEEQQQQTPAENKAESEEMETSQAGSKDKKMDQPPQAKKAKVKTSTVDLPIENQLLWQIDREMLNLYIENEGKMIMQDKLEKERNDAKNAVEEYVYEMRDKLSGEYEKFVSEDDRNSFTLKLEDTENWLYEDGEDQPKQVYVDKLAELKNLGQPIKIRFQESEERPKLFEELGKQIQQYMKIISSFKNKEDQYDHLDAADMTKVEKSTNEAMEWMNNKLNLQNKQSLTMDPVVKSKEIEAKIKELTSTCSPIISKPKPKVEPPKEEQKNAEQNGPVDGQGDNPGPQAAEQGTDTAVPSDSDKKLPEMDID

SEQ ID NO: 185 - DNA, 1050 bp, Homo sapiens
gtcgccgcctgacgccgcccgtcgccggcagcgcaggacacggcgccgagggtggggcgcgggcgtagtggcgccgggagtcgcgggtgcgcgcgggccgtgagtgtgcgcttttgagagtcgcggcggaaggagcccggccgccgcccgccggcatgagctacgaccgcgccatcaccgtcttctcgcccgacggccacctcttccaagtggagtacgcgcaggaggccgtcaagaagggctcgaccgcggttggtgttcgaggaagagacattgttgttcttggtgtggagaagaagtcagtggccaaactgcaggatgaaagaacagtgcggaagatctgtgctttggatgacaacgtctgcatggcctttgcaggcctcaccgccgatgcaaggatagtcatcaacagggcccgggtggagtgccagagccaccggctgactgtggaggacccggtcactgtggagtacatcacccgctacatcgccagtctgaagcagcgttatacgcagagcaatgggcgcaggccgtttggcatctctgccctcatcgtgggtttcgactttgatggcactcctaggctctatcagactgacccctcgggcacataccatgcctggaaggccaatgccataggtcggggtgccaagtcagtgcgcgagttcctggagaagaactatactgacgaagccattgaaacagatgatctgaccattaagctggtgatcaaggcactcctggaagtggttcagtcaggtggcaaaaacattgaacttgctgtcatgaggcgagatcaatccctcaagattttaaatcctgaagaaattgagaagtatgttgctgaaattgaaaaagaaaaagaagaaaacgaaaagaagaaacaaaagaaagcatcatgatgaataaaatgtctttgcttgtaatttttaaattcatatcaatcatggatgagtctcgatgtgtaggcctttccattccatttattcacactgagtgtcctacaataaacttccgtatttttaacctgttaaaaaaaaaaaaaaaaaa

SEQ ID NO: 186 - protein, 248 aa, Homo sapiens
MSYDRAITVFSPDGHLFQVEYAQEAVKKGSTAVGVRGRDIVVLGVEKKSVAKLQDERTVRKICALDDNVCMAFAGLTADARIVINRARVECQSHRLTVEDPVTVEYITRYIASLKQRYTQSNGRRPFGISALIVGFDFDGTPRLYQTDPSGTYHAWKANAIGRGAKSVREFLEKNYTDEAIETDDLTIKLVIKALLEVVQSGGKNIELAVMRRDQSLKILNPEEIEKYVAEIEKEKEENEKKKQKKAS

SEQ ID NO: 187 - DNA, 5905 bp, Homo sapiens
ctcctcccgcaccgccctgtcgcccaacggcggcctcaggagtgatcgggcagcagtcggccggccagcggacggcagagcgggcggacgggtaggcccggcctgctcttcgcgaggaggaagaaggtggccactctcccggtccccagaacctccccagcccccgcagtccgcccagaccgtaaagggggacgctgaggagccgcggacgctctccccggtgccgccgccgctgccgccgccatggctgccatgatggatcggaagtgagcattagggttaacggctgccggcgccggctcttcaagtcccggctccccggccgcctccacccggggaagcgcagcgcggcgcagctgactgctgcctctcacggccctcgcgaccacaagccctcaggtccggcgcgttccctgcaagactgagcggcggggagtggctcccggccgccggccccggctgcgagaaagatggcggacctggccgagtgcaacatcaaagtgatgtgtcgcttcagacctctcaacgagtctgaagtgaaccgcggcgacaagtacatcgccaagtttcagggagaagacacggtcgtgatcgcgtccaagccttatgcatttgatcgggtgttccagtcaagcacatctcaagagcaagtgtataatgactgtgcaaagaagattgttaaagatgtacttgaaggatataatggaacaatatttgcatatggacaaacatcctctgggaagacacacacaatggagggtaaacttcatgatccagaaggcatgggaattattccaagaatagtgcaagatatttttaattatatttactccatggatgaaaatttggaatttcatattaaggtttcatattttgaaatatatttggataagataagggacctgttagatgtttcaaagaccaacctttcagttcatgaagacaaaaaccgagttccctatgtaaaggggtgcacagagcgttttgtatgtagtccagatgaagttatggataccatagatgaaggaaaatccaacagacatgtagcagttacaaatatgaatgaacatagctctaggagtcacagtatatttcttattaatgtcaaacaagagaacacacaaacggaacaaaagctgagtggaaaactttatctggttgatttagctggtagtgaaaaggttagtaaaactggagctgaaggtgctgtgctggatgaagctaaaaacatcaacaagtcactttctgctcttggaaatgttatttctgctttggctgagggtagtacatatgttccatatcgagatagtaaaatgacaagaatccttcaagattcattaggtggcaactgtagaaccactattgtaatttgctgctctccatcatcatacaatgagtctgaaacaaaatctacactcttatttggccaaagggccaaaacaattaagaacacagtttgtgtcaatgtggagttaactgcagaacagtggaaaaagaagtatgaaaaagaaaaagaaaaaaataagatcctgcggaacactattcagtggcttgaaaatgagctcaacagatggcgtaatggggagacggtgcctattgatgaacagtttgacaaagagaaagccaacttggaagctttcacagtggataaagatattactcttaccaatgataaaccagcaaccgcaattggagttataggaaattttactgatgctgaaagaagaaagtgtgaagaagaaattgctaaattatacaaacagcttgatgacaaggatgaagaaattaaccagcaaagtcaactggtagagaaactgaagacgcaaatgttggatcaggaggagcttttggcatctaccagaagggatcaagacaatatgcaagctgagctgaatcgccttcaagcagaaaatgatgcctctaaagaagaagtgaaagaagttttacaggccctagaagaacttgctgtcaattatgatcagaagtctcaggaagttgaagacaaaactaaggaatatgaattgcttagtgatgaattgaatcagaaatcggcaactttagcgagtatagatgctgagcttcagaaacttaaggaaatgaccaaccaccagaaaaaacgagcagctgagatgatggcatctttactaaaagaccttgcagaaataggaattgctgtgggaaataatgatgtaaagcagcctgagggaactggcatgatagatgaagagttcactgttgcaagactctacattagcaaaatgaagtcagaagtaaaaaccatggtgaaacgttgcaagcagttagaaagcacacaaactgagagcaacaaaaaaatggaagaaaatgaaaaggagttagcagcatgtcagcttcgtatctctcaacatgaagccaaaatcaagtcattgactgaataccttcaaaatgtggaacaaaagaaaagacagttggaggaatctgtcgatgccctcagtgaagaactagtccagcttcgagcacaagagaaagtccatgaaatggaaaaggagcacttaaataaggttcagactgcaaatgaagttaagcaagctgttgaacagcagatccagagccatagagaaactcatcaaaaacagatcagtagtttgagagatgaagtagaagcaaaagcaaaacttattactgatcttcaagaccaaaaccagaaaatgatgttagagcaggaacgtctaagagtagaacatgagaagttgaaagccacagatcaggaaaagagcagaaaactacatgaacttacggttatgcaagatagacgagaacaagcaagacaagacttgaagggtttggaagagacagtggcaaaagaacttcagactttacacaacctgcgcaaactctttgttcaggacctggctacaagagttaaaaagagtgctgagattgattctgatgacaccggaggcagcgctgctcagaagcaaaaaatctcctttcttgaaaataatcttgaacagctcactaaagtgcacaaacagttggtacgtgataatgcagatctccgctgtgaacttcctaagttggaaaagcgacttcgagctacagctgagagagtgaaagctttggaatcagcactgaaagaagctaaagaaaatgcatctcgtgatcgcaaacgctatcagcaagaagtagatcgcataaaggaagcagtcaggtcaaagaatatggccagaagagggcattctgcacagattgctaaacctattcgtcccgggcaacatccagcagcttctccaactcacccaagtgcaattcgtggaggaggtgcatttgttcagaacagccagccagtggcagtgcgaggtggaggaggcaaacaagtgtaatcgtttatacatacccacaggtgttaaaaagtaatcgaagtacgaagaggacatggtatcaagcagtcattcaatgactataacctctactcccttgggattgtagaattataacttttaaaaaaaatgtataaattatacctggcctgtacagctgtttcctacctactcttcttgtaaactctgctgcttcccaacacaactagagtgcaattttggcatcttaggagggaaaaaggacagtttacaactgtggccctatttattacacagtttgtctatcgtgtcttaaatttagtctttactgtgccaagctaactgtaccttataggactgtactttttgtattttttgtgtatgtttattttttaatctcagtttaaattacctagctgctactgcttcttgtttttcttttcctattaaaacgtcttcctttttttttcttaagagaaaatggaacatttaggttaaatgtctttaaattttaccacttaacaacactacatgcccataaaatatatccagtcagtactgtattttaaaatcccttgaaatgatgatatcagggttaaaattacttgtattgtttctgaagtttgctcctgaaaactactgtttgagcactgaaacgttacaaatgcctaataggcatttgagactgagcaaggctacttgttatctcatgaaatgcctgttgccgagttattttgaatagaaatattttaaagtatcaaaagcagatcttagtttaagggagtttggaaaaggaattatatttctctttttcctgattctgtactcaacaagtcttgatggaattaaaatactctgctttattctggtgagcctgctagctaatataagtattggacaggtaataatttgtcatctttaatattagtaaaatgaattaagatattataggattaaacataattttatacggttagtactttattggccgacctaaatttatagcgtgtggaaattgagaaaaatgaagaaacaggacagatatatgatgaattaaaaatatatataggtcaattttggtctgaaatccctgaggtgtttttaacctgctacactaatttgtacactaatttatttctttagtctagaaatagtaaattgtttgcaagtcactaataatcattagataaattattttcttggccatagccgataattttgtaatcagtactaagtgtatacgtatttttgccactttttcctcagatgattaaagtaagtcaacagcttattttaggaaactgtaaaagtaatagggaaagagatttcactatttgcttcatcagtggtaggggggcggtgactgcaactgtgttagcagaaattcacagagaatggggatttaaggttagcagagaaacttggaaagttctgtgttaggatcttgctggcagaattaactttttgcaaaagttttatacacagatatttgtattaaatttggagccatagtcagaagactcagatcataattggcttatttttctatttccgtaactattgtaatttccacttttgtaataattttgatttaaaatataaatttatttatttatttttttaatagtcaaaaatctttgctgttgtagtctgcaacctctaaaatgattgtgttgcttttaggattgatcagaagaaacactccaaaaattgagatgaaatgttggtgcagccagttataagtaatatagttaacaagcaaaaaaagtgctgccaccttttatgatgattttctaaatggagaaacatttggctgcatccacatagacctttatgttttgttttcagttgaaaacttgcctcctttggcaacattcgtaaatgaagcagaatttttttttctcttttttccaaatatgttagttttgttcttgtaagatgtatcatgggtattggtgctgtgtaatgaacaacgaattttaattagcatgtggttcagaatatacaatgttaggtttttaaaaagtatcttgatggttcttttctatttataatttcagactttcataaagtgtaccaagaatttcataaatttgttttcagtgaactgctttttgctatggtaggtcattaaacacagcacttactcttaaaaatgaaaatttctgatcatctaggatattgacacatttcaatttgcagtgtctttttgactggatatattaacgttcctctgaatggcattgatagatggttcagaagagaaactcaatgaaataaagagaatatttattcatggcgattaattaaattatttgcctaacttaagaaaactactgtgcgtaactctcagtttgtgcttaactccatttgacatgaggtgacagaagagagtctgagtctacctgtggaatatgttggtttattttcagtgcttgaagatacattcacaaatacttggtttgggaagacaccgtttaattttaagttaacttgcatgttgtaaatgcgttttatgtttaaataaagaggaaaattttttgaaatgtaaaaaaaaaaaaaaaaaa

SEQ ID NO: 188 - protein, 963 aa, Homo sapiens
MADLAECNIKVMCRFRPLNESEVNRGDKYIAKFQGEDTVVIASKPYAFDRVFQSSTSQEQVYNDCAKKIVKDVLEGYNGTIFAYGQTSSGKTHTMEGKLHDPEGMGIIPRIVQDIFNYIYSMDENLEFHIKVSYFEIYLDKIRDLLDVSKTNLSVHEDKNRVPYVKGCTERFVCSPDEVMDTIDEGKSNRHVAVTNMNEHSSRSHSIFLINVKQENTQTEQKLSGKLYLVDLAGSEKVSKTGAEGAVLDEAKNINKSLSALGNVISALAEGSTYVPYRDSKMTRILQDSLGGNCRTTIVICCSPSSYNESETKSTLLFGQRAKTIKNTVCVNVELTAEQWKKKYEKEKEKNKILRNTIQWLENELNRWRNGETVPIDEQFDKEKANLEAFTVDKDITLTNDKPATAIGVIGNFTDAERRKCEEEIAKLYKQLDDKDEEINQQSQLVEKLKTQMLDQEELLASTRRDQDNMQAELNRLQAENDASKEEVKEVLQALEELAVNYDQKSQEVEDKTKEYELLSDELNQKSATLASIDAELQKLKEMTNHQKKRAAEMMASLLKDLAEIGIAVGNNDVKQPEGTGMIDEEFTVARLYISKMKSEVKTMVKRCKQLESTQTESNKKMEENEKELAACQLRISQHEAKIKSLTEYLQNVEQKKRQLEESVDALSEELVQLRAQEKVHEMEKEHLNKVQTANEVKQAVEQQIQSHRETHQKQISSLRDEVEAKAKLITDLQDQNQKMMLEQERLRVEHEKLKATDQEKSRKLHELTVMQDRREQARQDLKGLEETVAKELQTLHNLRKLFVQDLATRVKKSAEIDSDDTGGSAAQKQKISFLENNLEQLTKVHKQLVRDNADLRCELPKLEKRLRATAERVKALESALKEAKENASRDRKRYQQEVDRIKEAVRSKNMARRGHSAQIAKPIRPGQHPAASPTHPSAIRGGGAFVQNSQPVAVRGGGGKQV

SEQ ID NO: 189 - DNA, 514 bp, Homo sapiens
cttcctttttgtccgacatcttgacgaggctgcggtgtctgctgctattctccgagcttcgcaatgccgcctaaggacgacaagaagaagaaggacgctggaaagtcggccaagaaagacaaagacccagtgaacaaatccgggggcaaggccaaaaagaagaagtggtccaaaggcaaagttcgggacaagctcaataacttagtcttgtttgacaaagctacctatgataaactctgtaaggaagttcccaactataaacttataaccccagctgtggtctctgagagactgaagattcgaggctccctggccagggcagcccttcaggagctccttagtaaaggacttatcaaactggtttcaaagcacagagctcaagtaatttacaccagaaataccaagggtggagatgctccagctgctggtgaagatgcatgaataggtccaaccagctgtacatttggaaaaataaaactttattaaatcaaaaaaaaaaaaaaaaaaaaaaaaa

SEQ ID NO: 190 - protein, 125 aa, Homo sapiens [sequence omitted]

SEQ ID NO: 191 - DNA, 2567 bp, Homo sapiens
ctccggcgcagtgttgggactgtctgggtatcggaaagcaagcctacgttgctcactattacgtataatccttttcttttcaagatgcctgaggaagtgcaccatggagaggaggaggtggagacttttgcctttcaggcagaaattgcccaactcatgtccctcatcatcaataccttctattccaacaaggagattttccttcgggagttgatctctaatgcttctgatgccttggacaagattcgctatgagagcctgacagacccttcgaagttggacagtggtaaagagctgaaaattgacatcatccccaaccctcaggaacgtaccctgactttggtagacacaggcattggcatgaccaaagctgatctcataaataatttgggaaccattgccaagtctggtactaaagcattcatggaggctcttcaggctggtgcagacatctccatgattgggcagtttggtgttggcttttattctgcctacttggtggcagagaaagtggttgtgatcacaaagcacaacgatgatgaacagtatgcttgggagtcttctgctggaggttccttcactgtgcgtgctgaccatggtgagcccattggcaggggtaccaaagtgatcctccatcttaaagaagatcagacagagtacctagaagagaggcgggtcaaagaagtagtgaagaagcattctcagttcataggctatcccatcaccctttatttggagaaggaacgagagaaggaaattagtgatgatgaggcagaggaagagaaaggtgagaaagaagaggaagataaagatgatgaagaaaaacccaagatcgaagatgtgggttcagatgaggaggatgacagcggtaaggataagaagaagaaaactaagaagatcaaagagaaatacattgatcaggaagaactaaacaagaccaagcctatttggaccagaaaccctgatgacatcacccaagaggagtatggagaattctacaagagcctcactaatgactgggaagaccacttggcagtcaagcacttttctgtagaaggtcagttggaattcagggcattgctatttattcctcgtcgggctccctttgacctttttgagaacaagaagaaaaagaacaacatcaaactctatgtccgccgtgtgttcatcatggacagctgtgatgagttgataccagagtatctcaattttatccgtggtgtggttgactctgaggatctgcccctgaacatctcccgagaaatgctccagcagagcaaaatcttgaaagtcattcgcaaaaacattgttaagaagtgccttgagctcttctctgagctggcagaagacaaggagaattacaagaaattctatgaggcattctctaaaaatctcaagcttggaatccacgaagactccactaaccgccgccgcctgtctgagctgctgcgctatcatacctcccagtctggagatgagatgacatctctgtcagagtatgtttctcgcatgaaggagacacagaagtccatctattacatcactggtgagagcaaagagcaggtggccaactcagcttttgtggagcgagtgcggaaacggggcttcgaggtggtatatatgaccgagcccattgacgagtactgtgtgcagcagctcaaggaatttgatgggaagagcctggtctcagttaccaaggagggtctggagctgcctgaggatgaggaggagaagaagaagatggaagagagcaaggcaaagtttgagaacctctgcaagctcatgaaagaaatcttagataagaaggttgagaaggtgacaatctccaatagacttgtgtcttcaccttgctgcattgtgaccagcacctacggctggacagccaatatggagcggatcatgaaagcccaggcacttcgggacaactccaccatgggctatatgatggccaaaaagcacctggagatcaaccctgaccaccccattgtggagacgctgcggcagaaggctgaggccgacaagaatgataaggcagttaaggacctggtggtgctgctgtttgaaaccgccctgctatcttctggcttttcccttgaggatccccagacccactccaaccgcatctatcgcatgatcaagctaggtctaggtattgatgaagatgaagtggcagcagaggaacccaatgctgcagttcctgatgagatcccccctctcgagggcgatgaggatgcgtctcgcatggaagaagtcgattaggttaggagttcatagttggaaaacttgtgcccttgtatagtgtccccatgggctcccactgcagcctcgagtgcccctgtcccacctggctccccctgctggtgtctagtgtttttttccctctcctgtccttgtgttgaaggcagtaaactaagggtgtcaagccccattccctctctactcttgacagcaggattggatgttgtgtattgtggtttattttattttcttcattttgttctgaaattaaagtatgcaaaataaagaatatgccgttttaaaaaaaaaaaaaaaaaaaaaaaaaaaaa

SEQ ID NO: 192 - protein, 724 aa, Homo sapiens
MPEEVHHGEEEVETFAFQAEIAQLMSLIINTFYSNKEIFLRELISNASDALDKIRYESLTDPSKLDSGKELKIDIIPNPQERTLTLVDTGIGMTKADLINNLGTIAKSGTKAFMEALQAGADISMIGQFGVGFYSAYLVAEKVVVITKHNDDEQYAWESSAGGSFTVRADHGEPIGRGTKVILHLKEDQTEYLEERRVKEVVKKHSQFIGYPITLYLEKEREKEISDDEAEEEKGEKEEEDKDDEEKPKIEDVGSDEEDDSGKDKKKKTKKIKEKYIDQEELNKTKPIWTRNPDDITQEEYGEFYKSLTNDWEDHLAVKHFSVEGQLEFRALLFIPRRAPFDLFENKKKKNNIKLYVRRVFIMDSCDELIPEYLNFIRGVVDSEDLPLNISREMLQQSKILKVIRKNIVKKCLELFSELAEDKENYKKFYEAFSKNLKLGIHEDSTNRRRLSELLRYHTSQSGDEMTSLSEYVSRMKETQKSIYYITGESKEQVANSAFVERVRKRGFEVVYMTEPIDEYCVQQLKEFDGKSLVSVTKEGLELPEDEEEKKKMEESKAKFENLCKLMKEILDKKVEKVTISNRLVSSPCCIVTSTYGWTANMERIMKAQALRDNSTMGYMMAKKHLEINPDHPIVETLRQKAEADKNDKAVKDLVVLLFETALLSSGFSLEDPQTHSNRIYRMIKLGLGIDEDEVAAEEPNAAVPDEIPPLEGDEDASRMEEVD

SEQ ID NO: 193 - DNA, 7253 bp, Homo sapiens
ggaaagaagtggaataattaggaacctagggtggggtagggtagcaggacatttcaaacattaatgagcatatgagattccaggtcttgttaaaatgcaaattctgattcagctggtaggtgaggtctgagattgtgcatttctaacaagcactcagataatcttaaggctgttggccccagggtcacacttatagtgattttctagaacccagttggggaagtgaatcttgggcaggagaaatacacacctcttgcattgagtttggagatctcatctgatataactttttaagaaagaaaaataattttccaaatatccaattgataagctttcccactaagtggctttcccactaagtggctgcgttatgaaaattgcttcactttgaaacttctggtcttggtaatatagaatttctgtgttctcacagtgcttgattgagaatatgatattgagattatggcataaaatatagtggctgtacaaaaaaaaatacattattaggatctctaacaattatgtaaaagtcattgcttcatgggtagagctcaaactttggtgtgagacctggttttattcttggcacttactctgagttgtcttaggcaaattaataccttaagcaaaaatattctcatgtacattttacatgagaattataaatgaagtacataaagtccagcagtcacaaatgttatctattattaccatcgtcctaagactgcaatcagctatagtgaaagtagtctcaaagattgtttcataaatcatcagattcacctaattttctaaagaatttaaataaggagatggaatgaatagattgcattttgtttccatgcacaggggaactgtgcatatttcttctgtgactcggaaatggtttaacttttaaaaatcccaaaatagctgaagttagcagacatgcaatttaccaaggatgattggaatttttatctttcctgtaataatactatacccaagcacactgctcatgaggaaaacatttttatgtgaatcttttactcttgggggcaaagaatgctgtttttctttttgataactatgtttatagaatctaaatcaccctgagcaattatttcaacatctaaagttattattaccattcatgtttcatttatagctatttgaattttgatgaatttcaatatggtgctacagtgatagggcaagtgcaaataagttcaatatatgggtacggtctaaagctattttaatttttttattacaactgctatgaagaaaattaggatatgccatattttcacgttttacagttggatgtcctatgatgttctcttccagagaacagagctcggagctctggaaatttggaggcaactgatatgtgctcatgtctgcatctgtgtgggttggctgtatctcagggacagagtctgcagcaaaaaagatataattttgaggactgaacaaaattcaggaaggactattctcattaaggcagtaacagagaagaattttgaaacaaaagattttcgagcctctctagaaaatggtgttctgctgtgtgatttgattaataagcttaaacctggcgtcattaagaagatcaatagactgtctacaccaatagcaggattggataatataaacgttttcttgaaagcttgtgaacagattggattgaaagaagcccagcttttccatcctggagatctacaggatttatcaaatcgagtcactgtcaagcaagaagagactgacaggagagtgaaaaatgttttgataacattgtactggctgggaagaaaagcacaaagcaacccgtactataatggtccccatcttaatttgaaagcgtttgagaatcttttaggacaagcactgacgaaggcactcgaagactccagcttcctgaaaagaagtggcagggacagtggctacggtgacatctggtgtcctgaacgtggagaatttcttgctcctccaaggcaccataagagagaagattcctttgaaagcttggactctttgggctcgaggtcattgacaagctgctcctctgatatcacgttgagaggggggcgtgaaggttttgaaagtgacacagattcggaatttacatttaagatgcaggattataataaagatgatatgtcgtatcgaaggatttcggctgttgagccaaagactgcgttacccttcaatcgttttttacccaacaaaagtagacagccatcctatgtaccagcacctctgagaaagaaaaagccagacaaacatgaggataacagaagaagttgggcaagcccggtttatacagaagcagatggaacattttcaagactctttcaaaagatttatggtgagaatgggagtaagtccatgagtgatgtcagcgcagaagatgttcaaaacttgcgtcagctgcgttacgaggagatgcagaaaataaaatcacaattaaaagaacaagatcagaaatggcaggatgaccttgcaaaatggaaagatcgtcgaaaaagttacacttcagatctgcagaagaaaaaagaagagagagaagaaattgaaaagcaggcacttgagaagtctaagagaagctctaagacgtttaaggaaatgctgcaggacagggaatcccaaaatcaaaagtctacagttccgtcaagaaggagaatgtattcttttgatgatgtgctggaggaaggaaagcgaccccctacaatgactgtgtcagaagcaagttaccagagtgagagagtagaagagaagggagcaacttatccttcagaaattcccaaagaagattctaccacttttgcaaaaagagaggaccgtgtaacaactgaaattcagcttccttctcaaagtcctgtggaagaacaaagcccagcctctttgtcttctctgcgttcacggagcacacaaatggaatcaactcgtgtttcagcttctctccccagaagttaccggaaaactgatacagtcaggttaacatctgtggtcacaccaagaccctttggctctcagacaaggggaatctcatcactccccagatcttacacgatggatgatgcttggaagtataatggagatgttgaagacattaagagaactccaaacaatgtggtcagcacccctgcaccaagcccggacgcaagccaactggcttcaagcttatctagccagaaagaggtagcagcaacagaagaagatgtgacaaggctgccctctcctacatcccccttctcatctctttcccaagaccaggctgccacttctaaagccacattgtcttccacatctggtcttgatttaatgtctgaatctggagaaggggaaatctccccacaaagagaagtctcaagatcccaggatcagttcagtgatatgagaatcagcataaaccagacgcctgggaagagtcttgactttgggtttacaataaaatgggatattcctgggatcttcgtagcatcagttgaagcaggtagcccagcagaattttctcagctacaagtagatgatgaaattattgctattaacaacaccaagttttcatataacgattcaaaagagtgggaggaagccatggctaaggctcaagaaactggacacctagtgatggatgtgaggcgctatggaaaggctggttcacctgaaacaaagtggattgatgcaacttctggaatttacaactcagaaaaatcttcaaatctatctgtaacaactgatttctccgaaagccttcagagttctaatattgaatccaaagaaatcaatggaattcatgatgaaagcaatgcttttgaatcaaaagcatctgaatccatttctttgaaaaacttaaaaaggcgatcacaattttttgaacaaggaagctctgattcggtggttcctgatcttccagttccaaccatcagtgccccgagtcgctgggtgtgggatcaagaggaggagcggaagcggcaggagaggtggcagaaggagcaggaccgcctactgcaggaaaaatatcaacgtgagcaggagaaactgagggaagagtggcaaagggccaaacaggaggcagagagagagaattccaagtacttggatgaggaactgatggtcctaagctcaaacagcatgtctctgaccacacgggagccctctcttgccacctgggaagctacctggagtgaagggtccaagtcttcagacagagaaggaacccgagcaggagaagaggagaggagacagccacaagaggaagttgttcatgaggaccaaggaaagaagccgcaggatcagcttgttattgagagagagaggaaatgggagcaacagcttcaggaagagcaagagcaaaagcggcttcaggctgaggctgaggagcagaagcgtcctgcggaggagcagaagcgccaggcagagatagagcgggaaacatcagtcagaatataccagtacaggaggcctgttgattcctatgatataccaaagacagaagaagcatcttcaggttttcttcctggtgacaggaataaatccagatctactactgaactggatgattactccacaaataaaaatggaaacaataaatatttagaccaaattgggaacatgacctcttcacagaggagatccaagaaagaacaagtaccatcaggagcagaattggagaggcaacaaatccttcaggaaatgaggaagagaacaccccttcacaatgacaacagctggatccgacagcgcagtgccagtgtcaacaaagagcctgttagtcttcctgggatcatgagaagaggcgaatctttagataacctggactccccccgatccaattcttggagacagcctccttggctcaatcagcccacaggattctatgcttcttcctctgtgcaagactttagtcgcccaccacctcagctggtgtccacatcaaaccgtgcctacatgcggaacccctcctccagcgtgcccccaccttcagctggctccgtgaagacctccaccacaggtgtggccaccacacagtcccccaccccgagaagccattccccttcagcttcacagtcaggctctcagctgcgtaacaggtcagtcagtgggaagcgcatatgctcctactgcaataacattctgggcaaaggagccgccatgatcatcgagtccctgggtctttgttatcatttgcattgttttaagtgtgttgcctgtgagtgtgacctcggaggctcttcctcaggagctgaagtcaggatcagaaaccaccaactgtactgcaacgactgctatctcagattcaaatctggacggccaaccgccatgtgatgtaagcctccatacgaaagcactgttgcagatagaagaagaggtggttgctgctcatgtagatctataaatatgtgttgtatgtcttttttgctttttttttaaaaaaaagaataactttttttgcctctttagattacatagaagcattgtagtcttggtagaaccagtatttttgttgtttatttataaggtaattgtgtgtggggaaaagtgcagtatttacctgttgaattcagcatcttgagagcacaagggaaaaaataagaacctacgaatatttttgaggcagataatgatctagtttgactttctagttagtggtgttttgaagagggtattttattgttttttaaaaaaaggttcttaaacattatttgaaatagttaatataaatacataattgcatttgctctgtttattgtaatgtattctaaattaatgcagaaccatatggaaaatttcattaaaatctatccccaaatgtgctttctgtatccttccttctacctattattctgatttttaaaaatgcagttaatgtaccatttatttgcttgatgaagggagctctattttctttaccagaaatgttgctaagtaattcccaatagaaagctgcttattttcattaatgaaaaataaccatggtttgtatactagaagtcttcttcagaaactggtgagcctttctgttcaattgcatttgtaaataaacttgctgatgcatttaacgagtgggtcgtctttttcttaggtgtatgtgtctgacctcaggccttttagccatatttcagtatgtggccttttttgatgttatgttttatccagtagctttactaaggtataattgatgtaataaactgcatatatttaaagtgtatactttgacaaattttgacatggtgtataccttcgaaactatgccacagtctggatgtgtttactgaaacattttaataaggaagtttatttttgataaagttatgtttttggatacaatatatttgtatggtgagagtgatgaattgttggatcatttgaataaaatcttttactaaccccatgataaaaggagaagacaacagtgagcttagaatatctataaagcaaaaaatgtagtctcttgtttaaaaaatctggagcgggaatgcaaggatacaaaactttagcatgctttgagcaaaaatttaaacttactggaatcttttataataatgtaagtggaatggaggattctaggaactgagaactgtattggaataggttcaaaatatgtaagaaatgctaatgtgggagataaaaattttatttagtacttattctgattattattaaagtaataatgtgttccttgaggataacttgtcaaatgccccaaagcataaagaatataattctgaatcccaaattccaaagacaagaactctgtgtttgaattcattctgcatataattatttataagtatagattgtgaatttttccatgttcttaaaattatttttatcttttttcatggttgcatagtgctccattgtttggccttggtaatatttagttgataattccattactgtgtatttttcacttgtttctaagatcaaacattttaatatgtgcatgttatatataaatatgtaaattctgtgatactctatgatcatctctttctttatattattttcatagacatgaaatagttgctcagagattatgcattttaagacactcatagtatatattgccaaagtggtttccagaaaggcactgctggcttcgactcctataagcagcacgtgggcttgttcatctcactgcatgtttatgaagatacagttcttttgccttgttctctgcctgatgtgtatgcagaggcagccctcaatatgcagtggttgaataaatgaatgaagaaaccactatcaaaaaaaaaaaaaaaaaa

SEQ ID NO: 194 - protein, 1349 aa, Homo sapiens
MKKIRICHIFTFYSWMSYDVLFQRTELGALEIWRQLICAHVCICVGWLYLRDRVCSKKDIILRTEQNSGRTILIKAVTEKNFETKDFRASLENGVLLCDLINKLKPGVIKKINRLSTPIAGLDNINVFLKACEQIGLKEAQLFHPGDLQDLSNRVTVKQEETDRRVKNVLITLYWLGRKAQSNPYYNGPHLNLKAFENLLGQALTKALEDSSFLKRSGRDSGYGDIWCPERGEFLAPPRHHKREDSFESLDSLGSRSLTSCSSDITLRGGREGFESDTDSEFTFKMQDYNKDDMSYRRISAVEPKTALPFNRFLPNKSRQPSYVPAPLRKKKPDKHEDNRRSWASPVYTEADGTFSRLFQKIYGENGSKSMSDVSAEDVQNLRQLRYEEMQKIKSQLKEQDQKWQDDLAKWKDRRKSYTSDLQKKKEEREEIEKQALEKSKRSSKTFKEMLQDRESQNQKSTVPSRRRMYSFDDVLEEGKRPPTMTVSEASYQSERVEEKGATYPSEIPKEDSTTFAKREDRVTTEIQLPSQSPVEEQSPASLSSLRSRSTQMESTRVSASLPRSYRKTDTVRLTSVVTPRPFGSQTRGISSLPRSYTMDDAWKYNGDVEDIKRTPNNVVSTPAPSPDASQLASSLSSQKEVAATEEDVTRLPSPTSPFSSLSQDQAATSKATLSSTSGLDLMSESGEGEISPQREVSRSQDQFSDMRISINQTPGKSLDFGFTIKWDIPGIFVASVEAGSPAEFSQLQVDDEIIAINNTKFSYNDSKEWEEAMAKAQETGHLVMDVRRYGKAGSPETKWIDATSGIYNSEKSSNLSVTTDFSESLQSSNIESKEINGIHDESNAFESKASESISLKNLKRRSQFFEQGSSDSVVPDLPVPTISAPSRWVWDQEEERKRQERWQKEQDRLLQEKYQREQEKLREEWQRAKQEAERENSKYLDEELMVLSSNSMSLTTREPSLATWEATWSEGSKSSDREGTRAGEEERRQPQEEVVHEDQGKKPQDQLVIERERKWEQQLQEEQEQKRLQAEAEEQKRPAEEQKRQAEIERETSVRIYQYRRPVDSYDIPKTEEASSGFLPGDRNKSRSTTELDDYSTNKNGNNKYLDQIGNMTSSQRRSKKEQVPSGAELERQQILQEMRKRTPLHNDNSWIRQRSASVNKEPVSLPGIMRRGESLDNLDSPRSNSWRQPPWLNQPTGFYASSSVQDFSRPPPQLVSTSNRAYMRNPSSSVPPPSAGSVKTSTTGVATTQSPTPRSHSPSASQSGSQLRNRSVSGKRICSYCNNILGKGAAMIIESLGLCYHLHCFKCVACECDLGGSSSGAEVRIRNHQLYCNDCYLRFKSGRPTAM

SEQ ID NO: 195 - DNA, 6791 bp, Homo sapiens
aacaggtaatgtttaacgtgccagtcacaaagatcacagaaacagtgtatgcccgggcataagatagcacgactgtgtatgctctggaggactgaaaggctgtacaagccctatgtattttttttcaaatatacatatgcatgggtcttgctgctgcctcttttgctgactgtaattggactttgaagcttcgaagttatatcataaaaatttgtaacctttgtctgagagagagctcagctaagcaatcactttccacttcttttcacaggataatataaacgttttcttgaaagcttgtgaacagattggattgaaagaagcccagcttttccatcctggagatctacaggatttatcaaatcgagtcactgtcaagcaagaagagactgacaggagagtgaaaaatgttttgataacattgtactggctgggaagaaaagcacaaagcaacccgtactataatggtccccatcttaatttgaaagcgtttgagaatcttttaggacaagcactgacgaaggcactcgaagactccagcttcctgaaaagaagtggcagggacagtggctacggtgacatctggtgtcctgaacgtggagaatttcttgctcctccaaggcaccataagagagaagattcctttgaaagcttggactctttgggctcgaggtcattgacaagctgctcctctgatatcacgttgagaggggggcgtgaaggttttgaaagtgacacagattcggaatttacatttaagatgcaggattataataaagatgatatgtcgtatcgaaggatttcggctgttgagccaaagactgcgttacccttcaatcgttttttacccaacaaaagtagacagccatcctatgtaccagcacctctgagaaagaaaaagccagacaaacatgaggataacagaagaagttgggcaagcccggtttatacagaagcagatggaacattttcaagtaatcagaggaggatttggggcaccaatgtggagaactggccaactgtacaaggaacttcaaagtcctcttgttatttggaagaggaaaaagcaaagacaagaagcatacccaacattgtaaaggatgatctttatgtgcgcaagctcagtccagtcatgccaaacccagggaatgcttttgatcagtttcttcccaaatgttggaccccagaagatgtgaactggaaaagaataaaaagggaaacttataagccatggtataaagaatttcagggattcagtcagtttttactgcttcaggccctccaaacatactctgatgacatcttgtcttctgaaacacataccaaaattgatcccacttctggcccaaggctcataacccgcaggaagaatctctcttatgcaccaggctatagaagagatgacctcgagatggcagccctggatcctgacttagagaatgatgatttctttgtcagaaagactggggctttccatgcaaatccatatgttctccgagcttttgaagactttagaaagttctctgagcaagatgattctgtagagcgagatataattttacagtgtagagaaggtgaacttgtacttccggatttggaaaaagatgatatgattgttcgccgaattccagcacagaagaaagaagtgccgctgtctggggccccagatagataccacccagtcccttttcccgaaccctggactcttcctccagaaattcaagcaaaatttctctgtgtacttgaaaggacatgcccatccaaagaaaaaagtaatagctgtagaatattagttccttcatatcggcagaagaaagatgacatgctgacacgtaagattcagtcctggaaactgggaactaccgtgcctcccatcagtttcacccctggcccctgcagtgaggctgacttgaagagatgggaggccatccgggaggccagcagacttaggcacaagaaaaggctgatggtggagagactctttcaaaagatttatggtgagaatgggagtaagtccatgagtgatgtcagcgcagaagatgttcaaaacttgcgtcagctgcgttacgaggagatgcagaaaataaaatcacaattaaaagaacaagatcagaaatggcaggatgaccttgcaaaatggaaagatcgtcgaaaaagttacacttcagatctgcagaagaaaaaagaagagagagaagaaattgaaaagcaggcacttgagaagtctaagagaagctctaagacgtttaaggaaatgctgcaggacagggaatcccaaaatcaaaagtctacagttccgtcaagaaggagaatgtattcttttgatgatgtgctggaggaaggaaagcgaccccctacaatgactgtgtcagaagcaagttaccagagtgagagagtagaagagaagggagcaacttatccttcagaaattcccaaagaagattctaccacttttgcaaaaagagaggaccgtgtaacaactgaaattcagcttccttctcaaagtcctgtggaagaacaaagcccagcctctttgtcttctctgcgttcacggagcacacaaatggaatcaactcgtgtttcagcttctctccccagaagttaccggaaaactgatacagtcaggttaacatctgtggtcacaccaagaccctttggctctcagacaaggggaatctcatcactccccagatcttacacgatggatgatgcttggaagtataatggagatgttgaagacattaagagaactccaaacaatgtggtcagcacccctgcaccaagcccggacgcaagccaactggcttcaagcttatctagccagaaagaggtagcagcaacagaagaagatgtgacaaggctgccctctcctacatcccccttctcatctctttcccaagaccaggctgccacttctaaagccacattgtcttccacatctggtcttgatttaatgtctgaatctggagaaggggaaatctccccacaaagagaagtctcaagatcccaggatcagttcagtgatatgagaatcagcataaaccagacgcctgggaagagtcttgactttgggtttacaataaaatgggatattcctgggatcttcgtagcatcagttgaagcaggtagcccagcagaattttctcagctacaagtagatgatgaaattattgctattaacaacaccaagttttcatataacgattcaaaagagtgggaggaagccatggctaaggctcaagaaactggacacctagtgatggatgtgaggcgctatggaaaggctggttcacctgaaacaaagtggattgatgcaacttctggaatttacaactcagaaaaatcttcaaatctatctgtaacaactgatttctccgaaagccttcagagttctaatattgaatccaaagaaatcaatggaattcatgatgaaagcaatgcttttgaatcaaaagcatctgaatccatttctttgaaaaacttaaaaaggcgatcacaattttttgaacaaggaagctctgattcggtggttcctgatcttccagttccaaccatcagtgccccgagtcgctgggtgtgggatcaagaggaggagcggaagcggcaggagaggtggcagaaggagcaggaccgcctactgcaggaaaaatatcaacgtgagcaggagaaactgagggaagagtggcaaagggccaaacaggaggcagagagagagaattccaagtacttggatgaggaactgatggtcctaagctcaaacagcatgtctctgaccacacgggagccctctcttgccacctgggaagctacctggagtgaagggtccaagtcttcagacagagaaggaacccgagcaggagaagaggagaggagacagccacaagaggaagttgttcatgaggaccaaggaaagaagccgcaggatcagcttgttattgagagagagaggaaatgggagcaacagcttcaggaagagcaagagcaaaagcggcttcaggctgaggctgaggagcagaagcgtcctgcggaggagcagaagcgccaggcagagatagagcgggaaacatcagtcagaatataccagtacaggaggcctgttgattcctatgatataccaaagacagaagaagcatcttcaggttttcttcctggtgacaggaataaatccagatctactactgaactggatgattactccacaaataaaaatggaaacaataaatatttagaccaaattgggaacatgacctcttcacagaggagatccaagaaagaacaagtaccatcaggagcagaattggagaggcaacaaatccttcaggaaatgaggaagagaacaccccttcacaatgacaacagctggatccgacagcgcagtgccagtgtcaacaaagagcctgttagtcttcctgggatcatgagaagaggcgaatctttagataacctggactccccccgatccaattcttggagacagcctccttggctcaatcagcccacaggattctatgcttcttcctctgtgcaagactttagtcgcccaccacctcagctggtgtccacatcaaaccgtgcctacatgcggaacccctcctccagcgtgcccccaccttcagctggctccgtgaagacctccaccacaggtgtggccaccacacagtcccccaccccgagaagccattccccttcagcttcacagtcaggctctcagctgcgtaacagtgtgttgcctgtgagtgtgacctcggaggctcttcctcaggagctgaagtcaggatcagaaaccaccaactgtactgcaacgactgctatctcagattcaaatctggacggccaaccgccatgtgatgtaagcctccatacgaaagcactgttgcagatagaagaagaggtggttgctgctcatgtagatctataaatatgtgttgtatgtcttttttgctttttttttaaaaaaaagaataactttttttgcctctttagattacatagaagcattgtagtcttggtagaaccagtatttttgttgtttatttataaggtaattgtgtgtggggaaaagtgcagtatttacctgttgaattcagcatcttgagagcacaagggaaaaaataagaacctacgaatatttttgaggcagataatgatctagtttgactttctagttagtggtgttttgaagagggtattttattgttttttaaaaaaaggttcttaaacattatttgaaatagttaatataaatacataattgcatttgctctgtttattgtaatgtattctaaattaatgcagaaccatatggaaaatttcattaaaatctatccccaaatgtgctttctgtatccttccttctacctattattctgatttttaaaaatgcagttaatgtaccatttatttgcttgatgaagggagctctattttctttaccagaaatgttgctaagtaattcccaatagaaagctgcttattttcattaatgaaaaataaccatggtttgtatactagaagtcttcttcagaaactggtgagcctttctgttcaattgcatttgtaaataaacttgctgatgcatttaacgagtgggtcgtctttttcttaggtgtatgtgtctgacctcaggccttttagccatatttcagtatgtggccttttttgatgttatgttttatccagtagctttactaaggtataattgatgtaataaactgcatatatttaaagtgtatactttgacaaattttgacatggtgtataccttcgaaactatgccacagtctggatgtgtttactgaaacattttaataaggaagtttatttttgataaagttatgtttttggatacaatatatttgtatggtgagagtgatgaattgttggatcatttgaataaaatcttttactaaccccatgataaaaggagaagacaacagtgagcttagaatatctataaagcaaaaaatgtagtctcttgtttaaaaaatctggagcgggaatgcaaggatacaaaactttagcatgctttgagcaaaaatttaaacttactggaatcttttataataatgtaagtggaatggaggattctaggaactgagaactgtattggaataggttcaaaatatgtaagaaatgctaatgtgggagataaaaattttatttagtacttattctgattattattaaagtaataatgtgttccttgaggataacttgtcaaatgccccaaagcataaagaatataattctgaatcccaaattccaaagacaagaactctgtgtttgaattcattctgcatataattatttataagtatagattgtgaatttttccatgttcttaaaattatttttatcttttttcatggttgcatagtgctccattgtttggccttggtaatatttagttgataattccattactgtgtatttttcacttgtttctaagatcaaacattttaatatgtgcatgttatatataaatatgtaaattctgtgatactctatgatcatctctttctttatattattttcatagacatgaaatagttgctcagagattatgcattttaagacactcatagtatatattgccaaagtggtttccagaaaggcactgctggcttcgactcctataagcagcacgtgggcttgttcatctcactgcatgtttatgaagatacagttcttttgccttgttctctgcctgatgtgtatgcagaggcagccctcaatatgcagtggttgaataaatgaatgaagaaaccactatcaaaaaaaaaaaaaaaaaa

SEQ ID NO: 196 - protein, 1385 aa, Homo sapiens
MQDYNKDDMSYRRISAVEPKTALPFNRFLPNKSRQPSYVPAPLRKKKPDKHEDNRRSWASPVYTEADGTFSSNQRRIWGTNVENWPTVQGTSKSSCYLEEEKAKTRSIPNIVKDDLYVRKLSPVMPNPGNAFDQFLPKCWTPEDVNWKRIKRETYKPWYKEFQGFSQFLLLQALQTYSDDILSSETHTKIDPTSGPRLITRRKNLSYAPGYRRDDLEMAALDPDLENDDFFVRKTGAFHANPYVLRAFEDFRKFSEQDDSVERDIILQCREGELVLPDLEKDDMIVRRIPAQKKEVPLSGAPDRYHPVPFPEPWTLPPEIQAKFLCVLERTCPSKEKSNSCRILVPSYRQKKDDMLTRKIQSWKLGTTVPPISFTPGPCSEADLKRWEAIREASRLRHKKRLMVERLFQKIYGENGSKSMSDVSAEDVQNLRQLRYEEMQKIKSQLKEQDQKWQDDLAKWKDRRKSYTSDLQKKKEEREEIEKQALEKSKRSSKTFKEMLQDRESQNQKSTVPSRRRMYSFDDVLEEGKRPPTMTVSEASYQSERVEEKGATYPSEIPKEDSTTFAKREDRVTTEIQLPSQSPVEEQSPASLSSLRSRSTQMESTRVSASLPRSYRKTDTVRLTSVVTPRPFGSQTRGISSLPRSYTMDDAWKYNGDVEDIKRTPNNVVSTPAPSPDASQLASSLSSQKEVAATEEDVTRLPSPTSPFSSLSQDQAATSKATLSSTSGLDLMSESGEGEISPQREVSRSQDQFSDMRISINQTPGKSLDFGFTIKWDIPGIFVASVEAGSPAEFSQLQVDDEIIAINNTKFSYNDSKEWEEAMAKAQETGHLVMDVRRYGKAGSPETKWIDATSGIYNSEKSSNLSVTTDFSESLQSSNIESKEINGIHDESNAFESKASESISLKNLKRRSQFFEQGSSDSVVPDLPVPTISAPSRWVWDQEEERKRQERWQKEQDRLLQEKYQREQEKLREEWQRAKQEAERENSKYLDEELMVLSSNSMSLTTREPSLATWEATWSEGSKSSDREGTRAGEEERRQPQEEVVHEDQGKKPQDQLVIERERKWEQQLQEEQEQKRLQAEAEEQKRPAEEQKRQAEIERETSVRIYQYRRPVDSYDIPKTEEASSGFLPGDRNKSRSTTELDDYSTNKNGNNKYLDQIGNMTSSQRRSKKEQVPSGAELERQQILQEMRKRTPLHNDNSWIRQRSASVNKEPVSLPGIMRRGESLDNLDSPRSNSWRQPPWLNQPTGFYASSSVQDFSRPPPQLVSTSNRAYMRNPSSSVPPPSAGSVKTSTTGVATTQSPTPRSHSPSASQSGSQLRNSVLPVSVTSEALPQELKSGSETTNCTATTAISDSNLDGQPPCDVSLHTKALLQIEEEVVAAHVDL

SEQ ID NO: 197 - DNA, 2558 bp, Homo sapiens
gtggggcgcgacttccggggcggcggttgcatcagattctaggaagtgtctgtagccgcagctgcgggtccgggattcccagccatggcagattcctccgggcagcagggcaaaggccggcgtgtgcagccccagtggtcccctcctgctgggacccagccatgcagactccacctttacaacagcctcaccaggaacaaggaagtgttcatacctcaagatgggaaaaaggtgacgtggtattgctgtgggccaaccgtctatgacgcatctcacatggggcacgccaggtcctacatctcttttgatatcttgagaagagtgttgaaggattacttcaaatttgatgtcttttattgcatgaacattacggatattgatgacaagatcatcaagagggcccggcagaaccacctgttcgagcagtatcgggagaagaggcctgaagcggcacagctcttggaggatgttcaggccgccctgaagccattttcagtaaaattaaatgagaccacggatcccgataaaaagcagatgctcgaacggattcagcacgcagtgcagcttgccacagagccacttgagaaagctgtgcagtccagactcacgggagaggaagtcaacagctgtgtggaggtgttgctggaagaagccaaggatttgctctctgactggctggattctacacttggctgtgatgtcactgacaattccatcttctccaagctgcccaagttctgggagggggacttccacagagacatggaagctctgaatgttctccctccagatgtcttaacccgggttagtgagtatgtgccagaaattgtgaactttgtccagaagattgtggacaacggttacggctatgtctccaatgggtctgtctactttgatacagcgaagtttgcttctagcgagaagcactcctatgggaagctggtgcctgaggccgttggagatcagaaagcccttcaagaaggggaaggtgacctgagcatctctgcagaccgcctgagtgagaagcgctctcccaacgactttgccttatggaaggcctctaagcccggagaaccgtcctggccgtgcccttggggaaagggtcgtccgggctggcatatcgagtgctcggccatggcaggcaccctcctaggggcttcgatggacattcacggaggtgggttcgacctccggttcccccaccatgacaatgagctggcacagtcggaggcctactttgaaaacgactgctgggtcaggtacttcctgcacacaggccacctgaccattgcaggctgcaaaatgtcaaagtcactaaaaaacttcatcaccattaaagatgccttgaaaaagcactcagcacggcagttgcggctggccttcctcatgcactcgtggaaggacaccctggactactccagcaacaccatggagtcagcgcttcaatatgagaagttcttgaatgagtttttcttaaatgtgaaagatatccttcgcgctcctgttgacatcactggtcagtttgagaagtggggagaagaagaagcagaactgaataagaacttttatgacaagaagacagcaattcacaaagccctctgtgacaatgttgacacccgcaccgtcatggaagagatgcgggccttggtcagtcagtgcaacctctatatggcagcccggaaagccgtgaggaagaggcccaaccaggctctgctggagaacatcgccctgtacctcacccatatgctgaagatctttggggccgtagaagaggacagctccctgggattcccggtcggagggcctggaaccagcctcagtctcgaggccacagtcatgccctaccttcaggtgttatcagaattccgagaaggagtgcggaagattgcccgagagcaaaaagtccctgagattctgcagctcagcgatgccctgcgggacaacatcctgcccgagcttggggtgcggtttgaagaccacgaaggactgcccacagtggtgaaactggtagacagaaacaccttattaaaagagagagaagaaaagagacgggttgaagaggagaagaggaagaagaaagaggaggcggcccggaggaaacaggaacaagaagcagcaaagctggccaagatgaagattccccccagtgagatgttcttgtcagaaaccgacaaatactccaagtttgatgaaaatgtaagcatggtctgcccacacatgacatggagggcaaagagctcagcaaagggcaagccaagaagctgaagaagctcttcgaggctcaggagaagctctacaaggaatatctgcagatggcccagaatggaagcttccagtgagggggcacaggactgactttttaaaccattgtggactagtggctgctgtctgcctcagtgacaatgtcccagcgctcctatcatgtttacagtcacccttgggtcctaaattaagagttgtgttcatgtaggttcgtgtcgtcgttggctctgagacattgataataaatttttctcaacagtgagaccctcaaaaaaaaaaaaaaaaaaaaaaaaaaa

SEQ ID NO: 198 - protein, 726 aa, Homo sapiens
MADSSGQQGKGRRVQPQWSPPAGTQPCRLHLYNSLTRNKEVFIPQDGKKVTWYCCGPTVYDASHMGHARSYISFDILRRVLKDYFKFDVFYCMNITDIDDKIIKRARQNHLFEQYREKRPEAAQLLEDVQAALKPFSVKLNETTDPDKKQMLERIQHAVQLATEPLEKAVQSRLTGEEVNSCVEVLLEEAKDLLSDWLDSTLGCDVTDNSIFSKLPKFWEGDFHRDMEALNVLPPDVLTRVSEYVPEIVNFVQKIVDNGYGYVSNGSVYFDTAKFASSEKHSYGKLVPEAVGDQKALQEGEGDLSISADRLSEKRSPNDFALWKASKPGEPSWPCPWGKGRPGWHIECSAMAGTLLGASMDIHGGGFDLRFPHHDNELAQSEAYFENDCWVRYFLHTGHLTIAGCKMSKSLKNFITIKDALKKHSARQLRLAFLMHSWKDTLDYSSNTMESALQYEKFLNEFFLNVKDILRAPVDITGQFEKWGEEEAELNKNFYDKKTAIHKALCDNVDTRTVMEEMRALVSQCNLYMAARKAVRKRPNQALLENIALYLTHMLKIFGAVEEDSSLGFPVGGPGTSLSLEATVMPYLQVLSEFREGVRKIAREQKVPEILQLSDALRDNILPELGVRFEDHEGLPTVVKLVDRNTLLKEREEKRRVEEEKRKKKEEAARRKQEQEAAKLAKMKIPPSEMFLSETDKYSKFDENVSMVCPHMTWRAKSSAKGKPRS

SEQ ID NO: 199 - DNA, 2550 bp, Homo sapiens
gtggggcgcgacttccggggcggcggttgcatcagattctaggaagtgtctgtagccgcagctgcgggtccgggattcccagccatggcagattcctccgggcagcagggcaaaggccggcgtgtgcagccccagtggtcccctcctgctgggacccagccatgcagactccacctttacaacagcctcaccaggaacaaggaagtgttcatacctcaagatgggaaaaaggtgacgtggtattgctgtgggccaaccgtctatgacgcatctcacatggggcacgccaggtcctacatctcttttgatatcttgagaagagtgttgaaggattacttcaaatttgatgtcttttattgcatgaacattacggatattgatgacaagatcatcaagagggcccggcagaaccacctgttcgagcagtatcgggagaagaggcctgaagcggcacagctcttggaggatgttcaggccgccctgaagccattttcagtaaaattaaatgagaccacggatcccgataaaaagcagatgctcgaacggattcagcacgcagtgcagcttgccacagagccacttgagaaagctgtgcagtccagactcacgggagaggaagtcaacagctgtgtggaggtgttgctggaagaagccaaggatttgctctctgactggctggattctacacttggctgtgatgtcactgacaattccatcttctccaagctgcccaagttctgggagggggacttccacagagacatggaagctctgaatgttctccctccagatgtcttaacccgggttagtgagtatgtgccagaaattgtgaactttgtccagaagattgtggacaacggttacggctatgtctccaatgggtctgtctactttgatacagcgaagtttgcttctagcgagaagcactcctatgggaagctggtgcctgaggccgttggagatcagaaagcccttcaagaaggggaaggtgacctgagcatctctgcagaccgcctgagtgagaagcgctctcccaacgactttgccttatggaaggcctctaagcccggagaaccgtcctggccgtgcccttggggaaagggtcgtccgggctggcatatcgagtgctcggccatggcaggcaccctcctaggggcttcgatggacattcacggaggtgggttcgacctccggttcccccaccatgacaatgagctggcacagtcggaggcctactttgaaaacgactgctgggtcaggtacttcctgcacacaggccacctgaccattgcaggctgcaaaatgtcaaagtcactaaaaaacttcatcaccattaaagatgccttgaaaaagcactcagcacggcagttgcggctggccttcctcatgcactcgtggaaggacaccctggactactccagcaacaccatggagtcagcgcttcaatatgagaagttcttgaatgagtttttcttaaatgtgaaagatatccttcgcgctcctgttgacatcactggtcagtttgagaagtggggagaagaagaagcagaactgaataagaacttttatgacaagaagacagcaattcacaaagccctctgtgacaatgttgacacccgcaccgtcatggaagagatgcgggccttggtcagtcagtgcaacctctatatggcagcccggaaagccgtgaggaagaggcccaaccaggctctgctggagaacatcgccctgtacctcacccatatgctgaagatctttggggccgtagaagaggacagctccctgggattcccggtcggagggcctggaaccagcctcagtctcgaggccacagtcatgccctaccttcaggtgttatcagaattccgagaaggagtgcggaagattgcccgagagcaaaaagtccctgagattctgcagctcagcgatgccctgcgggacaacatcctgcccgagcttggggtgcggtttgaagaccacgaaggactgcccacagtggtgaaactggtagacagaaacaccttattaaaagagagagaagaaaagagacgggttgaagaggagaagaggaagaagaaagaggaggcggcccggaggaaacaggaacaagaagcagcaaagctggccaagatgaagattccccccagtgagatgttcttgtcagaaaccgacaaatactccaagtttgatgaaaatggtctgcccacacatgacatggagggcaaagagctcagcaaagggcaagccaagaagctgaagaagctcttcgaggctcaggagaagctctacaaggaatatctgcagatggcccagaatggaagcttccagtgagggggcacaggactgactttttaaaccattgtggactagtggctgctgtctgcctcagtgacaatgtcccagcgctcctatcatgtttacagtcacccttgggtcctaaattaagagttgtgttcatgtaggttcgtgtcgtcgttggctctgagacattgataataaatttttctcaacagtgagaccctcaaaaaaaaaaaaaaaaaaaaaaaaaaa

SEQ ID NO: 200 - protein, 748 aa, Homo sapiens
MADSSGQQGKGRRVQPQWSPPAGTQPCRLHLYNSLTRNKEVFIPQDGKKVTWYCCGPTVYDASHMGHARSYISFDILRRVLKDYFKFDVFYCMNITDIDDKIIKRARQNHLFEQYREKRPEAAQLLEDVQAALKPFSVKLNETTDPDKKQMLERIQHAVQLATEPLEKAVQSRLTGEEVNSCVEVLLEEAKDLLSDWLDSTLGCDVTDNSIFSKLPKFWEGDFHRDMEALNVLPPDVLTRVSEYVPEIVNFVQKIVDNGYGYVSNGSVYFDTAKFASSEKHSYGKLVPEAVGDQKALQEGEGDLSISADRLSEKRSPNDFALWKASKPGEPSWPCPWGKGRPGWHIECSAMAGTLLGASMDIHGGGFDLRFPHHDNELAQSEAYFENDCWVRYFLHTGHLTIAGCKMSKSLKNFITIKDALKKHSARQLRLAFLMHSWKDTLDYSSNTMESALQYEKFLNEFFLNVKDILRAPVDITGQFEKWGEEEAELNKNFYDKKTAIHKALCDNVDTRTVMEEMRALVSQCNLYMAARKAVRKRPNQALLENIALYLTHMLKIFGAVEEDSSLGFPVGGPGTSLSLEATVMPYLQVLSEFREGVRKIAREQKVPEILQLSDALRDNILPELGVRFEDHEGLPTVVKLVDRNTLLKEREEKRRVEEEKRKKKEEAARRKQEQEAAKLAKMKIPPSEMFLSETDKYSKFDENGLPTHDMEGKELSKGQAKKLKKLFEAQEKLYKEYLQMAQNGSFQ

SEQ ID NO: 201 - DNA, 2799 bp, Homo sapiens
gtggggcgcgacttccggggcggcggttgcatcagattctaggaagtgtctgtagccgcagctgcgggtccgggattcccagccatggcagattcctccgggcagcaggctcctgactacaggtccattctgagcattagtgacgaggcagccagggcacaagccctgaacgagcacctcagcacgcgtagctatgtccaggggtactcactgtcccaggcagacgtggacgcgttcaggcagctctcggccccgcccgctgacccccagctcttccacgtggctcggtggttcaggcacatagaagcgctcctgggtagcccctgtggcaaaggccagccctgcaggctccaagcaagcaaaggccggcgtgtgcagccccagtggtcccctcctgctgggacccagccatgcagactccacctttacaacagcctcaccaggaacaaggaagtgttcatacctcaagatgggaaaaaggtgacgtggtattgctgtgggccaaccgtctatgacgcatctcacatggggcacgccaggtcctacatctcttttgatatcttgagaagagtgttgaaggattacttcaaatttgatgtcttttattgcatgaacattacggatattgatgacaagatcatcaagagggcccggcagaaccacctgttcgagcagtatcgggagaagaggcctgaagcggcacagctcttggaggatgttcaggccgccctgaagccattttcagtaaaattaaatgagaccacggatcccgataaaaagcagatgctcgaacggattcagcacgcagtgcagcttgccacagagccacttgagaaagctgtgcagtccagactcacgggagaggaagtcaacagctgtgtggaggtgttgctggaagaagccaaggatttgctctctgactggctggattctacacttggctgtgatgtcactgacaattccatcttctccaagctgcccaagttctgggagggggacttccacagagacatggaagctctgaatgttctccctccagatgtcttaacccgggttagtgagtatgtgccagaaattgtgaactttgtccagaagattgtggacaacggttacggctatgtctccaatgggtctgtctactttgatacagcgaagtttgcttctagcgagaagcactcctatgggaagctggtgcctgaggccgttggagatcagaaagcccttcaagaaggggaaggtgacctgagcatctctgcagaccgcctgagtgagaagcgctctcccaacgactttgccttatggaaggcctctaagcccggagaaccgtcctggccgtgcccttggggaaagggtcgtccgggctggcatatcgagtgctcggccatggcaggcaccctcctaggggcttcgatggacattcacggaggtgggttcgacctccggttcccccaccatgacaatgagctggcacagtcggaggcctactttgaaaacgactgctgggtcaggtacttcctgcacacaggccacctgaccattgcaggctgcaaaatgtcaaagtcactaaaaaacttcatcaccattaaagatgccttgaaaaagcactcagcacggcagttgcggctggccttcctcatgcactcgtggaaggacaccctggactactccagcaacaccatggagtcagcgcttcaatatgagaagttcttgaatgagtttttcttaaatgtgaaagatatccttcgcgctcctgttgacatcactggtcagtttgagaagtggggagaagaagaagcagaactgaataagaacttttatgacaagaagacagcaattcacaaagccctctgtgacaatgttgacacccgcaccgtcatggaagagatgcgggccttggtcagtcagtgcaacctctatatggcagcccggaaagccgtgaggaagaggcccaaccaggctctgctggagaacatcgccctgtacctcacccatatgctgaagatctttggggccgtagaagaggacagctccctgggattcccggtcggagggcctggaaccagcctcagtctcgaggccacagtcatgccctaccttcaggtgttatcagaattccgagaaggagtgcggaagattgcccgagagcaaaaagtccctgagattctgcagctcagcgatgccctgcgggacaacatcctgcccgagcttggggtgcggtttgaagaccacgaaggactgcccacagtggtgaaactggtagacagaaacaccttattaaaagagagagaagaaaagagacgggttgaagaggagaagaggaagaagaaagaggaggcggcccggaggaaacaggaacaagaagcagcaaagctggccaagatgaagattccccccagtgagatgttcttgtcagaaaccgacaaatactccaagtttgatgaaaatggtctgcccacacatgacatggagggcaaagagctcagcaaagggcaagccaagaagctgaagaagctcttcgaggctcaggagaagctctacaaggaatatctgcagatggcccagaatggaagcttccagtgagggggcacaggactgactttttaaaccattgtggactagtggctgctgtctgcctcagtgacaatgtcccagcgctcctatcatgtttacagtcacccttgggtcctaaattaagagttgtgttcatgtaggttcgtgtcgtcgttggctctgagacattgataataaatttttctcaacagtgagaccctcaaaaaaaaaaaaaaaaaaaaaaaaaaa

SEQ ID NO: 202 - protein, 831 aa, Homo sapiens
MADSSGQQAPDYRSILSISDEAARAQALNEHLSTRSYVQGYSLSQADVDAFRQLSAPPADPQLFHVARWFRHIEALLGSPCGKGQPCRLQASKGRRVQPQWSPPAGTQPCRLHLYNSLTRNKEVFIPQDGKKVTWYCCGPTVYDASHMGHARSYISFDILRRVLKDYFKFDVFYCMNITDIDDKIIKRARQNHLFEQYREKRPEAAQLLEDVQAALKPFSVKLNETTDPDKKQMLERIQHAVQLATEPLEKAVQSRLTGEEVNSCVEVLLEEAKDLLSDWLDSTLGCDVTDNSIFSKLPKFWEGDFHRDMEALNVLPPDVLTRVSEYVPEIVNFVQKIVDNGYGYVSNGSVYFDTAKFASSEKHSYGKLVPEAVGDQKALQEGEGDLSISADRLSEKRSPNDFALWKASKPGEPSWPCPWGKGRPGWHIECSAMAGTLLGASMDIHGGGFDLRFPHHDNELAQSEAYFENDCWVRYFLHTGHLTIAGCKMSKSLKNFITIKDALKKHSARQLRLAFLMHSWKDTLDYSSNTMESALQYEKFLNEFFLNVKDILRAPVDITGQFEKWGEEEAELNKNFYDKKTAIHKALCDNVDTRTVMEEMRALVSQCNLYMAARKAVRKRPNQALLENIALYLTHMLKIFGAVEEDSSLGFPVGGPGTSLSLEATVMPYLQVLSEFREGVRKIAREQKVPEILQLSDALRDNILPELGVRFEDHEGLPTVVKLVDRNTLLKEREEKRRVEEEKRKKKEEAARRKQEQEAAKLAKMKIPPSEMFLSETDKYSKFDENGLPTHDMEGKELSKGQAKKLKKLFEAQEKLYKEYLQMAQNGSFQ

SEQ ID NO: 203 - DNA, 2807 bp, Homo sapiens
gtggggcgcgacttccggggcggcggttgcatcagattctaggaagtgtctgtagccgcagctgcgggtccgggattcccagccatggcagattcctccgggcagcaggctcctgactacaggtccattctgagcattagtgacgaggcagccagggcacaagccctgaacgagcacctcagcacgcgtagctatgtccaggggtactcactgtcccaggcagacgtggacgcgttcaggcagctctcggccccgcccgctgacccccagctcttccacgtggctcggtggttcaggcacatagaagcgctcctgggtagcccctgtggcaaaggccagccctgcaggctccaagcaagcaaaggccggcgtgtgcagccccagtggtcccctcctgctgggacccagccatgcagactccacctttacaacagcctcaccaggaacaaggaagtgttcatacctcaagatgggaaaaaggtgacgtggtattgctgtgggccaaccgtctatgacgcatctcacatggggcacgccaggtcctacatctcttttgatatcttgagaagagtgttgaaggattacttcaaatttgatgtcttttattgcatgaacattacggatattgatgacaagatcatcaagagggcccggcagaaccacctgttcgagcagtatcgggagaagaggcctgaagcggcacagctcttggaggatgttcaggccgccctgaagccattttcagtaaaattaaatgagaccacggatcccgataaaaagcagatgctcgaacggattcagcacgcagtgcagcttgccacagagccacttgagaaagctgtgcagtccagactcacgggagaggaagtcaacagctgtgtggaggtgttgctggaagaagccaaggatttgctctctgactggctggattctacacttggctgtgatgtcactgacaattccatcttctccaagctgcccaagttctgggagggggacttccacagagacatggaagctctgaatgttctccctccagatgtcttaacccgggttagtgagtatgtgccagaaattgtgaactttgtccagaagattgtggacaacggttacggctatgtctccaatgggtctgtctactttgatacagcgaagtttgcttctagcgagaagcactcctatgggaagctggtgcctgaggccgttggagatcagaaagcccttcaagaaggggaaggtgacctgagcatctctgcagaccgcctgagtgagaagcgctctcccaacgactttgccttatggaaggcctctaagcccggagaaccgtcctggccgtgcccttggggaaagggtcgtccgggctggcatatcgagtgctcggccatggcaggcaccctcctaggggcttcgatggacattcacggaggtgggttcgacctccggttcccccaccatgacaatgagctggcacagtcggaggcctactttgaaaacgactgctgggtcaggtacttcctgcacacaggccacctgaccattgcaggctgcaaaatgtcaaagtcactaaaaaacttcatcaccattaaagatgccttgaaaaagcactcagcacggcagttgcggctggccttcctcatgcactcgtggaaggacaccctggactactccagcaacaccatggagtcagcgcttcaatatgagaagttcttgaatgagtttttcttaaatgtgaaagatatccttcgcgctcctgttgacatcactggtcagtttgagaagtggggagaagaagaagcagaactgaataagaacttttatgacaagaagacagcaattcacaaagccctctgtgacaatgttgacacccgcaccgtcatggaagagatgcgggccttggtcagtcagtgcaacctctatatggcagcccggaaagccgtgaggaagaggcccaaccaggctctgctggagaacatcgccctgtacctcacccatatgctgaagatctttggggccgtagaagaggacagctccctgggattcccggtcggagggcctggaaccagcctcagtctcgaggccacagtcatgccctaccttcaggtgttatcagaattccgagaaggagtgcggaagattgcccgagagcaaaaagtccctgagattctgcagctcagcgatgccctgcgggacaacatcctgcccgagcttggggtgcggtttgaagaccacgaaggactgcccacagtggtgaaactggtagacagaaacaccttattaaaagagagagaagaaaagagacgggttgaagaggagaagaggaagaagaaagaggaggcggcccggaggaaacaggaacaagaagcagcaaagctggccaagatgaagattccccccagtgagatgttcttgtcagaaaccgacaaatactccaagtttgatgaaaatgtaagcatggtctgcccacacatgacatggagggcaaagagctcagcaaagggcaagccaagaagctgaagaagctcttcgaggctcaggagaagctctacaaggaatatctgcagatggcccagaatggaagcttccagtgagggggcacaggactgactttttaaaccattgtggactagtggctgctgtctgcctcagtgacaatgtcccagcgctcctatcatgtttacagtcacccttgggtcctaaattaagagttgtgttcatgtaggttcgtgtcgtcgttggctctgagacattgataataaatttttctcaacagtgagaccctcaaaaaaaaaaaaaaaaaaaaaaaaaaa

SEQ ID NO: 204 - protein, 809 aa, Homo sapiens
MADSSGQQAPDYRSILSISDEAARAQALNEHLSTRSYVQGYSLSQADVDAFRQLSAPPADPQLFHVARWFRHIEALLGSPCGKGQPCRLQASKGRRVQPQWSPPAGTQPCRLHLYNSLTRNKEVFIPQDGKKVTWYCCGPTVYDASHMGHARSYISFDILRRVLKDYFKFDVFYCMNITDIDDKIIKRARQNHLFEQYREKRPEAAQLLEDVQAALKPFSVKLNETTDPDKKQMLERIQHAVQLATEPLEKAVQSRLTGEEVNSCVEVLLEEAKDLLSDWLDSTLGCDVTDNSIFSKLPKFWEGDFHRDMEALNVLPPDVLTRVSEYVPEIVNFVQKIVDNGYGYVSNGSVYFDTAKFASSEKHSYGKLVPEAVGDQKALQEGEGDLSISADRLSEKRSPNDFALWKASKPGEPSWPCPWGKGRPGWHIECSAMAGTLLGASMDIHGGGFDLRFPHHDNELAQSEAYFENDCWVRYFLHTGHLTIAGCKMSKSLKNFITIKDALKKHSARQLRLAFLMHSWKDTLDYSSNTMESALQYEKFLNEFFLNVKDILRAPVDITGQFEKWGEEEAELNKNFYDKKTAIHKALCDNVDTRTVMEEMRALVSQCNLYMAARKAVRKRPNQALLENIALYLTHMLKIFGAVEEDSSLGFPVGGPGTSLSLEATVMPYLQVLSEFREGVRKIAREQKVPEILQLSDALRDNILPELGVRFEDHEGLPTVVKLVDRNTLLKEREEKRRVEEEKRKKKEEAARRKQEQEAAKLAKMKIPPSEMFLSETDKYSKFDENVSMVCPHMTWRAKSSAKGKPRS

SEQ ID NO: 205 - DNA, 2755 bp, Homo sapiens
ctaatcaccaaacatctgcttccttctctgtagctgtgaccctgataccgcgtggtgtgctccgaacacatggtgcccagaacgaaggcggcgtccagaagccctaggtcccagaggtccgctcagcggcaggcgcataaggcggggccggcgcgggcctttccttccatcggaaccgttctcccggggctgagtccctgcccggactccgaacgccgaagaccaggggccggaagcgcgcgccgccactgccacgccgtgtcagtcgggagggagggagcgagcaggcgaagccgcggaggacggggtgaagatggcggccttctccgagatgggtgtaatgcctgagattgcacaagctgtggaagagatggattggctcctcccaactgatatccaggctgaatctatcccattgatcttaggaggaggtgatgtacttatggctgcagaaacaggaagtggcaaaactggtgcttttagtattccagttatccagatagtttatgaaactctgaaagaccaacaggaaggcaaaaaaggaaaaacaacaattaaaactggtgcttcagtgctgaacaaatggcagatgaacccatatgacagaggatctgcttttgcaattgggtcagatggtctttgttgtcaaagcagagaagtaaaggaatggcatgggtgtagagctactaaaggattaatgaaagggaaacactactatgaagtatcctgtcatgaccaagggttatgcagggtcgggtggtctaccatgcaggcctctttggacctaggtactgacaagtttggatttggctttggtggaacaggaaagaaatcccataacaaacaatttgataattatggagaggaattcactatgcatgataccattggatgttacctggatatagataagggacatgtcaagttctccaaaaatggaaaagatcttggtctggcatttgaaataccaccacatatgaaaaaccaagccctctttcctgcctgtgttttgaagaatgctgaactgaaatttaacttcggtgaagaggaatttaagtttccaccaaaagatggctttgttgctctttccaaggcaccggatggttacattgtcaaatcacagcactcaggtaatgcacaggtgacacaaacaaagtttctccccaatgctccgaaagctctcattgttgaaccttcccgggagttagctgaacaaactttgaacaacatcaagcagtttaagaaatacattgataatcctaaattaagggagcttctgataattggaggtgttgcagcccgggatcagctctctgttttggaaaatggagtagatatagttgtaggtactccgggaagactagatgacttggtgtcaactggaaagctgaacttatctcaagttagattcctggtcctggatgaagctgatgggcttctttctcaaggttattctgattttataaataggatgcacaatcagattcctcaggttacctctgatggaaaaagacttcaggtgattgtttgctctgccactttgcattctttcgatgtaaagaaactgtccgagaagataatgcattttcctacatgggttgacttaaaaggagaagactctgttccagatactgtacaccatgttgttgtcccagtaaatcccaaaactgacagactctgggaaaggcttggaaagagccacattagaactgatgatgtacatgcaaaagataacacaagacctggtgctaatagtccagagatgtggtctgaagctattaaaatcctgaaaggggagtatgctgtccgggcaatcaaggaacataagatggatcaagcaattatcttctgtagaaccaaaattgactgtgataacttggagcagtactttatacaacaaggaggaggacctgataaaaaaggacaccagttctcatgtgtttgtcttcatggtgacagaaagcctcatgagagaaagcaaaacttggaaagatttaagaaaggagatgtaagattcttgatttgcacagatgtagctgctagaggaattgatatccacggtgttccttatgttataaatgtcactctgcccgatgaaaagcaaaactacgtacatcgaattggcagagtaggaagagctgaaaggatgggtctggcaatttccctggtggcaacagaaaaagaaaaggtttggtaccatgtatgtagcagccgtggaaaagggtgttataacacaagactcaaggaagatggaggctgtaccatatggtacaacgagatgcagttactatctgagatagaagaacacctgaactgtaccatttctcaggttgagccggatataaaggtaccagtggatgaatttgatgggaaagttacctacggtcagaaaagggctgctggtggtggaagctataaaggccatgtggatattttggcacctactgttcaagagttggctgcccttgaaaaggaggcgcagacatctttcctgcatcttggctaccttcctaaccagctgttcagaaccttctgatttttacatttactgaataagatttgagtaatgaaagtctgtagtcttaaaactctaaaacagttgtactgcttccaagcagcagtatttatagtaacgtaagctattaatgctaactcttgcatgtcaagaaacattagtcttaggaattcttcaaaaaatggcatcccaatgaaaataaatttgatgactatattttcatgaaaaaaaaaaaaaaaa

SEQ ID NO: 206 - protein, 740 aa, Homo sapiens
MAAFSEMGVMPEIAQAVEEMDWLLPTDIQAESIPLILGGGDVLMAAETGSGKTGAFSIPVIQIVYETLKDQQEGKKGKTTIKTGASVLNKWQMNPYDRGSAFAIGSDGLCCQSREVKEWHGCRATKGLMKGKHYYEVSCHDQGLCRVGWSTMQASLDLGTDKFGFGFGGTGKKSHNKQFDNYGEEFTMHDTIGCYLDIDKGHVKFSKNGKDLGLAFEIPPHMKNQALFPACVLKNAELKFNFGEEEFKFPPKDGFVALSKAPDGYIVKSQHSGNAQVTQTKFLPNAPKALIVEPSRELAEQTLNNIKQFKKYIDNPKLRELLIIGGVAARDQLSVLENGVDIVVGTPGRLDDLVSTGKLNLSQVRFLVLDEADGLLSQGYSDFINRMHNQIPQVTSDGKRLQVIVCSATLHSFDVKKLSEKIMHFPTWVDLKGEDSVPDTVHHVVVPVNPKTDRLWERLGKSHIRTDDVHAKDNTRPGANSPEMWSEAIKILKGEYAVRAIKEHKMDQAIIFCRTKIDCDNLEQYFIQQGGGPDKKGHQFSCVCLHGDRKPHERKQNLERFKKGDVRFLICTDVAARGIDIHGVPYVINVTLPDEKQNYVHRIGRVGRAERMGLAISLVATEKEKVWYHVCSSRGKGCYNTRLKEDGGCTIWYNEMQLLSEIEEHLNCTISQVEPDIKVPVDEFDGKVTYGQKRAAGGGSYKGHVDILAPTVQELAALEKEAQTSFLHLGYLPNQLFRTF

SEQ ID NO: 207 - DNA, 2333 bp, Homo sapiens
ctcacatccggcatgcgccgtgctcgctcacagaactacactttccaactctccccacacgacccgtgacactctgtggaccgcgagcacggagcagggtttctacagctgctccccactttctcggacccggtcctggacccagcccccgactccgacacggctccaccatggaggaggcggaccgaatcctcatccattcgctgcgccaggccggcacggcagttcctccagatgtgcagaccttgcgcgccttcaccactgagctggttgtagaggctgtggtccgctgcctgcgtgtgatcaaccctgcggtgggctctggcctcagccctctgctgcctcttgccatgtctgcccggttccgcctggccatgagcctggctcaggcctgcatggacctgggctatcccttggagcttggctatcagaacttcctctaccccagtgagcctgacctccgagacctgcttctcttcttggctgagcgtctgcccaccgatgcctctgaggatgcagaccagcctgcaggtgactcagctattctcctccgggccattgggagccaaattcgggaccagctggcactgccttgggtcccgccccaccttcgcactcccaagctgcagcacctccagggctcggccctccagaagcctttccatgccagcaggctggtcgtgccagaattgagttccagaggtgagccacgggagttccaggcgagtcccctgctgcttccagtccctacccaggtgcctcagcctgttggaagggtggcctcgctcctcgaacaccatgccctgcagctctgccagcagacgggccgggaccggccaggggatgaggactgggtccaccggacatcccgcctcccaccccaggaggacacacgggctcagcggcagcggctgcagaagcaactgactgagcatctgcgccaaagctggggcctgcttggggcccccatacaagcccgggacctgggagaactgctgcaggcctggggtgctggggccaagactggtgctcctaagggctcccgcttcacgcactcagagaagttcaccttccatctggagccccaggcccaggccactcaggtgtcagatgtgccagccacctcccggcggcctgaacaggtcacgtgggcagctcaggaacaggagctcgagtcccttcgggagcagctggaaggagtgaaccgcagcattgaggaggttgaggccgacatgaagaccctgggcgtcagctttgtgcaggcagagtctgagtgccggcacagcaagctcagtacagcagagcgtgagcaggccctgcgcctgaagagccgcgcggtggagctgctgcccgatgggactgccaaccttgccaagctgcagcttgtggtggagaatagtgcccagcgggtcatccacttggcgggtcagtgggagaagcaccgggtcccactcctcgctgagtaccgccacctccgaaagctgcaggattgcagagagctggaatcttctcgacggctggcagagatccaagaactgcaccagagtgtccgggcggctgctgaagaggcccgcaggaaggaggaggtctataagcagctgatgtcagagctggagactctgcccagagatgtgtcccggctggcctacacccagcgcatcctggagatcgtgggcaacatccggaagcagaaggaagagatcaccaagatcttgtctgatacgaaggagcttcagaaggaaatcaactccctatctgggaagctggaccggacgtttgcggtgactgatgagcttgtgttcaaggatgccaagaaggacgatgctgttcggaaggcctataagtatctagctgctctgcacgagaactgcagccagctcatccagaccatcgaggacacaggcaccatcatgcgggaggttcgagacctcgaggagcagatcgagacagagctgggcaagaagaccctcagcaacctggagaagatccgggaggactaccgagccctccgccaggagaacgctggcctcctaggccgggtccgggaggcctgaggagccgccggcagaggtctctccccagcctcaggcagggatttggggtgctggaggcagtggccaagcacatgccctagctacttcctccgctgtccagttcctcctgctgcggccttggacccagacccctgcccactgaccgcaacccttatatggggtgatagtccagcatgtggggagctcggctgcagtttattggggacggtactgtgggttgggggccttggatcccaaataaatgagtagttcctctgcagtctaaaaaaaaaaaaaaaa

SEQ ID NO: 208 - protein, 627 aa, Homo sapiens
MEEADRILIHSLRQAGTAVPPDVQTLRAFTTELVVEAVVRCLRVINPAVGSGLSPLLPLAMSARFRLAMSLAQACMDLGYPLELGYQNFLYPSEPDLRDLLLFLAERLPTDASEDADQPAGDSAILLRAIGSQIRDQLALPWVPPHLRTPKLQHLQGSALQKPFHASRLVVPELSSRGEPREFQASPLLLPVPTQVPQPVGRVASLLEHHALQLCQQTGRDRPGDEDWVHRTSRLPPQEDTRAQRQRLQKQLTEHLRQSWGLLGAPIQARDLGELLQAWGAGAKTGAPKGSRFTHSEKFTFHLEPQAQATQVSDVPATSRRPEQVTWAAQEQELESLREQLEGVNRSIEEVEADMKTLGVSFVQAESECRHSKLSTAEREQALRLKSRAVELLPDGTANLAKLQLVVENSAQRVIHLAGQWEKHRVPLLAEYRHLRKLQDCRELESSRRLAEIQELHQSVRAAAEEARRKEEVYKQLMSELETLPRDVSRLAYTQRILEIVGNIRKQKEEITKILSDTKELQKEINSLSGKLDRTFAVTDELVFKDAKKDDAVRKAYKYLAALHENCSQLIQTIEDTGTIMREVRDLEEQIETELGKKTLSNLEKIREDYRALRQENAGLLGRVREA

SEQ ID NO: 209 - DNA, 4452 bp, Homo sapiens
ttattttccccggagagtcccgaggcgccgcgccttggccctgcctacagcccgaggccccgcccccggcgcccctcccagccgtttgaagcggctcgggctgcggctggctcagagtggcgcggggggcgtggggcggtgctgaggagctgaagccgtggccagctcgacgccggacagtccagcgagcagcacggcgggaaccggcagccggagcagtcccggagcagaagcagcagcagcagcagcagccctcgccgttcgcggagcgcagccgagccggccatggcgttgtcgatgccgctgaatgggctgaaggaggaggacaaagagcccctcatcgagctcttcgtcaaggctggcagtgatggtgaaagcataggaaactgccccttttcccagaggctcttcatgattctttggctcaaaggagttgtatttagtgtgacgactgttgacctgaaaaggaagccagcagacctgcagaacttggctcccgggacccacccaccatttataactttcaacagtgaagtcaaaacggatgtaaataagattgaggaatttcttgaagaagtcttatgccctcccaagtacttaaagctttcaccaaaacacccagaatcaaatactgctggaatggacatctttgccaaattctctgcatatatcaagaattcaaggccagaggctaatgaagcactggagaggggtctcctgaaaaccctgcagaaactggatgaatatctgaattctcctctccctgatgaaattgatgaaaatagtatggaggacataaagttttctacacgtaaatttctggatggcaatgaaatgacattagctgattgcaacctgctgcccaaactgcatattgtcaaggtggtggccaaaaaatatcgcaactttgatattccaaaagaaatgactggcatctggagatacctaactaatgcatacagtagggacgagttcaccaatacctgtcccagtgataaggaggttgaaatagcatatagtgatgtagccaaaagactcaccaagtaaaatcgcgtttgtaaaagagatgtcttcatgtcttcccctaagaatacgcttttcctaacaggctactccttcctgtagagcagaaattgtattttgcacgaacatgcagttattgaagattaggatcaaggatagacaaggtatagtagttatcttaaaatatacactcctaagcagtattattttaaaatcctttaccctggctacctcccctacccgggttcccctctctttaatttggagacactccaccacaaacttttcactttagaggtagcttgccatctctcaggagccctcaccattgtgtccattcactgtgtatagatggcagaacttttgaggtgcaatgtttaattgttaaaaatagtagccacgactttatcaggcagccccaaactggtgcataatgcatggtacaagaaatatttatgtattttttggaattttgtaatatttagtaagagtatatgaaaggattgctactgtatcagaaatattgtttcaatttagtctatcctggatatgtactaacgaatattaccaccagagaagagagctttctacaaaagtcactacagattttgctatattgctttgtagatagatttttacttttgcctaaaagcatttatccttcataccaattgtaacatctgacaccatgtagaagctaaaagtttagagggagtgagggttttctcaagaccttcctcaagcattttatctttagaagagaaactgatgggcacctgatactctgtctaaatacgtttgttatatgtgttttgccctgtgccattcatttggaactttattgcattctttattttaaaaagcttgtttttacgtaatcatagagcttgctatttgtacatctgttgagcaacactacataactgatttttagttgacttagctatagcagtacaatgattagtaatgtaaaaattaacacagaaattaacctaaggaatgaagggtgggtttgtcaaaatatcaagtaaatttttgtttctaaagtacatttaatgtagatgacctaaagaatgcgttatccatcctatataaaagaaagataaaacacaggtcaccaattttctcatttcaccccatttaccttgtatagaggattgttcattcctttgggactaagttatagttatggtgagtgtgtatttactgtagttttgcctgatctcactcattgcacttcctggagttaaattttccaacagccatgttgaggaatagcactctgcatgtttttgttttgtttttcggggttttttttaattgaagccctaaaccaggaattatttgtgttctaacaggaggatgaacttgctgaaaataaaactttgctatgtatttactcttttttaaaagacaaaagcaaaaccagactttctacgtactactccaaagactgtgattgtgactataatacatttttggtaatttttttatacctaatttgtataggaagtgctatttctcataggctgtttcttgaaattttaagtttattgctttaaaatggcagtgtttctcccactttgatatgctaacatttagtaagcactggctttatgaaagcggctttttataagtatactgcattttttgagcctatcattaattagcttagtatgaaagataagaaaatctccatgttgtatccatttggctcaggaagattctttgccttacctttcttagaactctttattgcttatcaaaagtttgagtacccgcttggtttttttttggtaattaaatattgtatgatttatctggttcaaggaagatgcactattcagttatctattgagaaattattttgcagtggttttagtgggtgaaaatgtcccatctgcaccagtacacaggcaggcattatcattcttcacctactttttaaatagtggcaacttgggattcattctggtgattctgaaccttgcctcatagcttaaagtataaaaaagattcaagagcagtgaggtttgttctttccagtgaatggtggactgagtggtgcgaggtggagggctaacaagaggaaagaactacattcttcagaatacagtgatgaaaattcattttgaaactcaaatattttcattttggatattctcctgtttttattaaaccagtgattacacctggccatccctctaaatgttctaggaaggcatgtctattgtgattttgatgaagacagaattatttttctctgtagaaacacagataccactttatcagggaagttagtcaaatgaaatggaaattggtaaatggacaaaagctagctagtaaaaaggacgacccagcaacatgctttaaccccattgtatgtttgtggaaagagcatagtttaacatcttgagaaatttgggacataaagttttcatggtagacagttcatgcagtatatgaattgccataatggaaataatctgattttatttttacaactaacatccattccccttcatttaaacaccttttgtgttttacttcagtgaggagattggagtctgaatggatctgttttccaagagattctgagaaatttttgtattcagcagttggaaagctctctattctagttgataaaacttcccttttttgatgtagatgcagatattctatacagttctgttgtcttttactaggactgtaaacttttgtgataaaattcaaataagattttatttcttggtaattttggctttcacaatttatctttaaatccttgagcaatctgtatacaattaagagatttctgacatttattcttacactaaatggatcaactctaggatttaggcatgttaacttctgttgtgttttgaatctctccagagttgcatgtagatagcatttatttctgtgcccttaaacccatttagaaaataactacaaagtaaaaatgtagaggaaatagaaatgtattttttcatgaacattttgatacaaatttcatcatttaatgattcaccaatttcttgcattaatttgaatttaagcatttaattcaaagagaggggagcatccattattgatacatgtgggcttttaaaaactccatcctttataaatagtcaaggtttgggccacacaaagtatatttttatcatggaaaaatttcaactcctcaagccgtaatgttgaacagaattggagtattttctttataatttcttgaacaggcaaatgaaagcttattatagaatgcatgtattttcttttatctttggaacatcagcaccagtatattgctggcagctattgtattaaaaaataaagtatattttcactatcataaaggattcttttttcccccctcatgaaaataaacaacaacttggggtaaaagtgaaaaaaaaaaaaaaaaaa

SEQ ID NO: 210 - protein, 253 aa, Homo sapiens
MALSMPLNGLKEEDKEPLIELFVKAGSDGESIGNCPFSQRLFMILWLKGVVFSVTTVDLKRKPADLQNLAPGTHPPFITFNSEVKTDVNKIEEFLEEVLCPPKYLKLSPKHPESNTAGMDIFAKFSAYIKNSRPEANEALERGLLKTLQKLDEYLNSPLPDEIDENSMEDIKFSTRKFLDGNEMTLADCNLLPKLHIVKVVAKKYRNFDIPKEMTGIWRYLTNAYSRDEFTNTCPSDKEVEIAYSDVAKRLTK

SEQ ID NO: 211 - DNA, 3579 bp, Homo sapiens
gatgacgtaggctgcgcctgtgcatgcgcagggaggggagaccttggcggagcggcggaggcgcccagcggaggtgaaagtattggcggaaaggaaaatacagcggaaaaatgcagagctggagtcgtgtgtactgctccttggccaagagaggccatttcaatcgaatatctcatggcctacagggactttctgcagtgcctctgagaacttacgcagatcagccgattgatgctgatgtaacagttataggttctggtcctggaggatatgttgctgctattaaagctgcccagttaggcttcaagacagtctgcattgagaaaaatgaaacacttggtggaacatgcttgaatgttggttgtattccttctaaggctttattgaacaactctcattattaccatatggcccatggaaaagattttgcatctagaggaattgaaatgtccgaagttcgcttgaatttagacaagatgatggagcagaagagtactgcagtaaaagctttaacaggtggaattgcccacttattcaaacagaataaggttgttcatgtcaatggatatggaaagataactggcaaaaatcaagtcactgctacgaaagctgatggcggcactcaggttattgatacaaagaacattcttatagccacgggttcagaagttactccttttcctggaatcacgatagatgaagatacaatagtgtcatctacaggtgctttatctttaaaaaaagttccagaaaagatggttgttattggtgcaggagtaataggtgtagaattgggttcagtttggcaaagacttggtgcagatgtgacagcagttgaatttttaggtcatgtaggtggagttggaattgatatggagatatctaaaaactttcaacgcatccttcaaaaacaggggtttaaatttaaattgaatacaaaggttactggtgctaccaagaagtcagatggaaaaattgatgtttctattgaagctgcttctggtggtaaagctgaagttatcacttgtgatgtactcttggtttgcattggccgacgaccctttactaagaatttgggactagaagagctgggaattgaactagatcccagaggtagaattccagtcaataccagatttcaaactaaaattccaaatatctatgccattggtgatgtagttgctggtccaatgctggctcacaaagcagaggatgaaggcattatctgtgttgaaggaatggctggtggtgctgtgcacattgactacaattgtgtgccatcagtgatttacacacaccctgaagttgcttgggttggcaaatcagaagagcagttgaaagaagagggtattgagtacaaagttgggaaattcccatttgctgctaacagcagagctaagacaaatgctgacacagatggcatggtgaagatccttgggcagaaatcgacagacagagtactgggagcacatattcttggaccaggtgctggagaaatggtaaatgaagctgctcttgctttggaatatggagcatcctgtgaagatatagctagagtctgtcatgcacatccgaccttatcagaagcttttagagaagcaaatcttgctgcgtcatttggcaaatcaatcaacttttgaattagaagattatatatatttttttctgaaatttcctgggagcttttgtagaagtcacattcctgaacaggatattctcacagctccaagaatttctaggactgaattatgaaacttttggaaggtatttaataggtttggacaaaatggaatactcttatatctatattttacataaatttagtattttgtttcagtgcactaatgtgtaagacaaaaagctacttattgtagcatcctggaatatctccgtcaactcatattttcatgctgttcatgaaagattcaatgcccctgaatttaaatagcttttttctctgatacagaaaagttgaattttacatggctggagctagaatttgatatgtgaacagttgtgtttgaagcacagtgatcaagttatttttaatttggttttcacattggaaacaagtcagtcattcagatatgattcaaatgtctataaaccgaactgatgtaagtaaacggtctctcacttgttttatttaacctctaaattctttcattttaggggtagcatttgtgttgaagaggttttaaagcttccattgttgtctgcaactctgaagggtaattatatagttacccaaattaagagagtctatttacggaactcaaatacgtgggcattcaaatgtattacagtggggaatgaagatactgaaataaacgtcttaaatattcatttactggttatcatgagtacgtgttgagatggtcatagttttttttatgactacttctagtgtatattctaatttcttttctaggcctgaatgtatctttattttcatgttataggacaatattaaggcattttaaaggtcatcatcctttcatctattttagatacacctactaaatgtttaatatatacttttggagaagtacaacataagggagtctttaatctgtgttttccttggctgggttaatgactgtttatttaaagagtgttgtaaaattggatgtgtggtgtttaaaatggccatgtcctgaggaaacttaagtaacaaagtactaaatgctaagtaggcttttgcatattgtaactaaatttaagaataattcagattaagtagttctgaaatttggtatagatagcatagattgtctcatgctcatgagtgacataatgaccctggattctgttacatacttctaaagaaaattgattgttgtcttaggaggcagttaacttggctgaacaccaactccacactctgtcttgtttgtaggtggcagcagctgaaatctcttctcagttgttttagctttagctatgctgctggaagtctttcccatgcaagtgtgtagttcaggggtcaaccagagtttgggcagaaggaagtctgccccttctgtgcctcctgttttttgggggtttcccctttatgttccagctgttgtggttgccccatattctgccttctgatccttaaccaataaaacttggcttttgtttccccctcaagtgagaacccgttaaaaatgagacattgagccagtgctgttcactttttaagtgccaacttccctctactttccacttgtttatagttgtttccagtgcctttagttttttctaaaatatatttgttcagagtttgcagttgctatcagcaggagggttggtctgatatctgtgtgctactttgccattattggaagtgaactctgcatctttttaaaaatttgaaatcccggtatcatgtgaagtgctgtttatgtaaatctcaacatatcccttactcagggaaaaaaaagtttttagttagggaatagtgaaatataatttaatatggaattctagctgtagagttaaatccatctttaagtgtttacattcagtatgagaatgcaaatttatctgtatggggaataaagtcctaggaataaaacaagttttaagtgttca

SEQ ID NO: 212 - protein, 509 aa, Homo sapiens
MQSWSRVYCSLAKRGHFNRISHGLQGLSAVPLRTYADQPIDADVTVIGSGPGGYVAAIKAAQLGFKTVCIEKNETLGGTCLNVGCIPSKALLNNSHYYHMAHGKDFASRGIEMSEVRLNLDKMMEQKSTAVKALTGGIAHLFKQNKVVHVNGYGKITGKNQVTATKADGGTQVIDTKNILIATGSEVTPFPGITIDEDTIVSSTGALSLKKVPEKMVVIGAGVIGVELGSVWQRLGADVTAVEFLGHVGGVGIDMEISKNFQRILQKQGFKFKLNTKVTGATKKSDGKIDVSIEAASGGKAEVITCDVLLVCIGRRPFTKNLGLEELGIELDPRGRIPVNTRFQTKIPNIYAIGDVVAGPMLAHKAEDEGIICVEGMAGGAVHIDYNCVPSVIYTHPEVAWVGKSEEQLKEEGIEYKVGKFPFAANSRAKTNADTDGMVKILGQKSTDRVLGAHILGPGAGEMVNEAALALEYGASCEDIARVCHAHPTLSEAFREANLAASFGKSINF

SEQ ID NO: 213 - DNA, 2656 bp, Homo sapiens
gtgtgtgtggcgcctgcgcagtggcggtgaccaccggctcgcggcgcgtggaggctgctcccagccgcgcgcgagtcagactcgggtgggggtcccggcggcggtagcggcggcggcggtgcgagcatgtcgtggctcttcggcattaacaagggccccaagggtgaaggcgcggggccgccgccgcctttgccgcccgcgcagcccggggccgagggcggcggggaccgcgggttgggagaccggccggcgcccaaggacaaatggagcaacttcgaccccaccggcctggagcgcgccgccaaggcggcgcgcgagctggagcactcgcgttatgccaaggacgccctgaatctggcacagatgcaggagcagacgctgcagttggagcaacagtccaagctcaaaatgcggctggaagccctgagcctgctgcacacactagtctgggcatggagtctctgccgtgccggagccgtgcagacacaggagcggctgtcaggcagtgccagccctgagcaagtgccagctggtgagtgctgtgctctgcaggagtatgaggccgccgtggagcagctcaagagcgagcagatccgggcgcaggctgaggagaggaggaagaccctgagcgaggagacccggcagcaccaggccagggcccagtatcaagacaagctggcccggcagcgctacgaggaccaactgaagcagcagcaacttctcaatgaggagaatttacggaagcaggaggagtccgtgcagaagcaggaagccatgcggcgagccaccgtggagcgggagatggagctgcggcacaagaatgagatgctgcgagtggaggccgaggcccgggcgcgcgccaaggccgagcgggagaatgcagacatcatccgcgagcagatccgcctgaaggcggccgagcaccgtcagaccgtcttggagtccatcaggacggctggcaccttgtttggggaaggattccgtgcctttgtgacagactgggacaaagtgacagccacggtggctgggctgacgctgctggctgttggggtctactcagccaagaatgccacgcttgtcgccggccgcttcatcgaggctcggctggggaagccgtccctagtgagggagacgtcccgcatcacggtgcttgaggcgctgcggcaccccatccaggtcagccggcggctcctcagtcgaccccaggacgcgctggagggtgttgtgctcagtcccagcctggaagcacgggtgcgcgacatcgccatagcaacaaggaacaccaagaagaaccgcagcctgtacaggaacatcctgatgtacgggccaccaggcaccgggaagacgctgtttgccaagaaactcgccctgcactcaggcatggactacgccatcatgacaggcggggacgtggcccccatggggcgggaaggcgtgaccgccatgcacaagctctttgactgggccaataccagccggcgcggcctcctgctctttgtggatgaagcggacgccttccttcggaagcgagccaccgagaagataagcgaggacctcagggccacactgaacgccttcctgtaccgcacgggccagcacagcaacaagttcatgctggtcctggccagcaaccaaccagagcagttcgactgggccatcaatgaccgcatcaatgagatggtccacttcgacctgccagggcaggaggaacgggagcgcctggtgagaatgtattttgacaagtatgttcttaagccggccacagaaggaaagcagcgcctgaagctggcccagtttgactacgggaggaagtgctcggaggtcgctcggctgacggagggcatgtcgggccgggagatcgctcagctggccgtgtcctggcaggccacggcgtatgcctccgaggacggggtcctgaccgaggccatgatggacacccgcgtgcaagatgctgtccagcagcaccagcagaagatgtgctggctgaaggcggaagggcctgggcgtggggacgagccctccccatcctgagtccacagggagatccacagctcacggagcctggccgcggacccctcccacccctgccttgccggcccctgcacatttaggatatgctcctgggtggggactgggctgtgcccagggcctctgtcccccaggatgtcttgtggtgcgggtcggccgttctgccccccagggcaccccctgttgtaggcactggctagggaggggcaggcctccttcctgcccctcgagacactcttgggagatgcattttccgtctggctcacagggggagggtgaggctttgcaccccagcccctgcccaggccactgtgagggtgggtgctggctgagcccccggggcagcaggagccaggcaggtgatgtctttgttctcggctcccacagcagagccaggtgagggggcgcctgccagggccagacccaggtggggcagcctgaaccctgcttccccctgtggccggcatgccccgatctttcacacactggtgaccctgagagaggagggaggagggaacctggcgggggtgtctgaggccgcactgtcagctggccggtccaagcctgtggctggagctggggtctgtttacctaataaagtcccacaggtgcctcattaaaaaaaaaa

SEQ ID NO: 214 - protein, 634 aa, Homo sapiens
MSWLFGINKGPKGEGAGPPPPLPPAQPGAEGGGDRGLGDRPAPKDKWSNFDPTGLERAAKAARELEHSRYAKDALNLAQMQEQTLQLEQQSKLKMRLEALSLLHTLVWAWSLCRAGAVQTQERLSGSASPEQVPAGECCALQEYEAAVEQLKSEQIRAQAEERRKTLSEETRQHQARAQYQDKLARQRYEDQLKQQQLLNEENLRKQEESVQKQEAMRRATVEREMELRHKNEMLRVEAEARARAKAERENADIIREQIRLKAAEHRQTVLESIRTAGTLFGEGFRAFVTDWDKVTATVAGLTLLAVGVYSAKNATLVAGRFIEARLGKPSLVRETSRITVLEALRHPIQVSRRLLSRPQDALEGVVLSPSLEARVRDIAIATRNTKKNRSLYRNILMYGPPGTGKTLFAKKLALHSGMDYAIMTGGDVAPMGREGVTAMHKLFDWANTSRRGLLLFVDEADAFLRKRATEKISEDLRATLNAFLYRTGQHSNKFMLVLASNQPEQFDWAINDRINEMVHFDLPGQEERERLVRMYFDKYVLKPATEGKQRLKLAQFDYGRKCSEVARLTEGMSGREIAQLAVSWQATAYASEDGVLTEAMMDTRVQDAVQQHQQKMCWLKAEGPGRGDEPSPS

SEQ ID NO: 215 - DNA, 2512 bp, Homo sapiens
gtgtgtgtggcgcctgcgcagtggcggtgaccaccggctcgcggcgcgtggaggctgctcccagccgcgcgcgagtcagactcgggtgggggtcccggcggcggtagcggcggcggcggtgcgagcatgtcgtggctcttcggcattaacaagggccccaagggtgaaggcgcggggccgccgccgcctttgccgcccgcgcagcccggggccgagggcggcggggaccgcgggttgggagaccggccggcgcccaaggacaaatggagcaacttcgaccccaccggcctggagcgcgccgccaaggcggcgcgcgagctggagcactcgcgttatgccaaggacgccctgaatctggcacagatgcaggagcagacgctgcagttggagcaacagtccaagctcaaagagtatgaggccgccgtggagcagctcaagagcgagcagatccgggcgcaggctgaggagaggaggaagaccctgagcgaggagacccggcagcaccaggccagggcccagtatcaagacaagctggcccggcagcgctacgaggaccaactgaagcagcagcaacttctcaatgaggagaatttacggaagcaggaggagtccgtgcagaagcaggaagccatgcggcgagccaccgtggagcgggagatggagctgcggcacaagaatgagatgctgcgagtggaggccgaggcccgggcgcgcgccaaggccgagcgggagaatgcagacatcatccgcgagcagatccgcctgaaggcggccgagcaccgtcagaccgtcttggagtccatcaggacggctggcaccttgtttggggaaggattccgtgcctttgtgacagactgggacaaagtgacagccacggtggctgggctgacgctgctggctgttggggtctactcagccaagaatgccacgcttgtcgccggccgcttcatcgaggctcggctggggaagccgtccctagtgagggagacgtcccgcatcacggtgcttgaggcgctgcggcaccccatccaggtcagccggcggctcctcagtcgaccccaggacgcgctggagggtgttgtgctcagtcccagcctggaagcacgggtgcgcgacatcgccatagcaacaaggaacaccaagaagaaccgcagcctgtacaggaacatcctgatgtacgggccaccaggcaccgggaagacgctgtttgccaagaaactcgccctgcactcaggcatggactacgccatcatgacaggcggggacgtggcccccatggggcgggaaggcgtgaccgccatgcacaagctctttgactgggccaataccagccggcgcggcctcctgctctttgtggatgaagcggacgccttccttcggaagcgagccaccgagaagataagcgaggacctcagggccacactgaacgccttcctgtaccgcacgggccagcacagcaacaagttcatgctggtcctggccagcaaccaaccagagcagttcgactgggccatcaatgaccgcatcaatgagatggtccacttcgacctgccagggcaggaggaacgggagcgcctggtgagaatgtattttgacaagtatgttcttaagccggccacagaaggaaagcagcgcctgaagctggcccagtttgactacgggaggaagtgctcggaggtcgctcggctgacggagggcatgtcgggccgggagatcgctcagctggccgtgtcctggcaggccacggcgtatgcctccgaggacggggtcctgaccgaggccatgatggacacccgcgtgcaagatgctgtccagcagcaccagcagaagatgtgctggctgaaggcggaagggcctgggcgtggggacgagccctccccatcctgagtccacagggagatccacagctcacggagcctggccgcggacccctcccacccctgccttgccggcccctgcacatttaggatatgctcctgggtggggactgggctgtgcccagggcctctgtcccccaggatgtcttgtggtgcgggtcggccgttctgccccccagggcaccccctgttgtaggcactggctagggaggggcaggcctccttcctgcccctcgagacactcttgggagatgcattttccgtctggctcacagggggagggtgaggctttgcaccccagcccctgcccaggccactgtgagggtgggtgctggctgagcccccggggcagcaggagccaggcaggtgatgtctttgttctcggctcccacagcagagccaggtgagggggcgcctgccagggccagacccaggtggggcagcctgaaccctgcttccccctgtggccggcatgccccgatctttcacacactggtgaccctgagagaggagggaggagggaacctggcgggggtgtctgaggccgcactgtcagctggccggtccaagcctgtggctggagctggggtctgtttacctaataaagtcccacaggtgcctcattaaaaaaaaaa

SEQ ID NO: 216 - protein, 586 aa, Homo sapiens
MSWLFGINKGPKGEGAGPPPPLPPAQPGAEGGGDRGLGDRPAPKDKWSNFDPTGLERAAKAARELEHSRYAKDALNLAQMQEQTLQLEQQSKLKEYEAAVEQLKSEQIRAQAEERRKTLSEETRQHQARAQYQDKLARQRYEDQLKQQQLLNEENLRKQEESVQKQEAMRRATVEREMELRHKNEMLRVEAEARARAKAERENADIIREQIRLKAAEHRQTVLESIRTAGTLFGEGFRAFVTDWDKVTATVAGLTLLAVGVYSAKNATLVAGRFIEARLGKPSLVRETSRITVLEALRHPIQVSRRLLSRPQDALEGVVLSPSLEARVRDIAIATRNTKKNRSLYRNILMYGPPGTGKTLFAKKLALHSGMDYAIMTGGDVAPMGREGVTAMHKLFDWANTSRRGLLLFVDEADAFLRKRATEKISEDLRATLNAFLYRTGQHSNKFMLVLASNQPEQFDWAINDRINEMVHFDLPGQEERERLVRMYFDKYVLKPATEGKQRLKLAQFDYGRKCSEVARLTEGMSGREIAQLAVSWQATAYASEDGVLTEAMMDTRVQDAVQQHQQKMCWLKAEGPGRGDEPSPS

SEQ ID NO: 217 - DNA, 2342 bp, Homo sapiens
gggagccctggcccttgccgctcctcgccgctgtcggcagccacttcccgggcgagactgcgcccccggagcacccccggccggagccgtgtcgcgtgccgggaggatcggactctttccgtcacccgtttgcacctctgcagctgtcaggagcgggtcaggttatgccaaggacgccctgaatctggcacagatgcaggagcagacgctgcagttggagcaacagtccaagctcaaagagtatgaggccgccgtggagcagctcaagagcgagcagatccgggcgcaggctgaggagaggaggaagaccctgagcgaggagacccggcagcaccaggccagggcccagtatcaagacaagctggcccggcagcgctacgaggaccaactgaagcagcagcaacttctcaatgaggagaatttacggaagcaggaggagtccgtgcagaagcaggaagccatgcggcgagccaccgtggagcgggagatggagctgcggcacaagaatgagatgctgcgagtggaggccgaggcccgggcgcgcgccaaggccgagcgggagaatgcagacatcatccgcgagcagatccgcctgaaggcggccgagcaccgtcagaccgtcttggagtccatcaggacggctggcaccttgtttggggaaggattccgtgcctttgtgacagactgggacaaagtgacagccacggtggctgggctgacgctgctggctgttggggtctactcagccaagaatgccacgcttgtcgccggccgcttcatcgaggctcggctggggaagccgtccctagtgagggagacgtcccgcatcacggtgcttgaggcgctgcggcaccccatccaggtcagccggcggctcctcagtcgaccccaggacgcgctggagggtgttgtgctcagtcccagcctggaagcacgggtgcgcgacatcgccatagcaacaaggaacaccaagaagaaccgcagcctgtacaggaacatcctgatgtacgggccaccaggcaccgggaagacgctgtttgccaagaaactcgccctgcactcaggcatggactacgccatcatgacaggcggggacgtggcccccatggggcgggaaggcgtgaccgccatgcacaagctctttgactgggccaataccagccggcgcggcctcctgctctttgtggatgaagcggacgccttccttcggaagcgagccaccgagaagataagcgaggacctcagggccacactgaacgccttcctgtaccgcacgggccagcacagcaacaagttcatgctggtcctggccagcaaccaaccagagcagttcgactgggccatcaatgaccgcatcaatgagatggtccacttcgacctgccagggcaggaggaacgggagcgcctggtgagaatgtattttgacaagtatgttcttaagccggccacagaaggaaagcagcgcctgaagctggcccagtttgactacgggaggaagtgctcggaggtcgctcggctgacggagggcatgtcgggccgggagatcgctcagctggccgtgtcctggcaggccacggcgtatgcctccgaggacggggtcctgaccgaggccatgatggacacccgcgtgcaagatgctgtccagcagcaccagcagaagatgtgctggctgaaggcggaagggcctgggcgtggggacgagccctccccatcctgagtccacagggagatccacagctcacggagcctggccgcggacccctcccacccctgccttgccggcccctgcacatttaggatatgctcctgggtggggactgggctgtgcccagggcctctgtcccccaggatgtcttgtggtgcgggtcggccgttctgccccccagggcaccccctgttgtaggcactggctagggaggggcaggcctccttcctgcccctcgagacactcttgggagatgcattttccgtctggctcacagggggagggtgaggctttgcaccccagcccctgcccaggccactgtgagggtgggtgctggctgagcccccggggcagcaggagccaggcaggtgatgtctttgttctcggctcccacagcagagccaggtgagggggcgcctgccagggccagacccaggtggggcagcctgaaccctgcttccccctgtggccggcatgccccgatctttcacacactggtgaccctgagagaggagggaggagggaacctggcgggggtgtctgaggccgcactgtcagctggccggtccaagcctgtggctggagctggggtctgtttacctaataaagtcccacaggtgcctcattaaaaaaaaaa

SEQ ID NO: 218 - protein, 507 aa, Homo sapiens
MQEQTLQLEQQSKLKEYEAAVEQLKSEQIRAQAEERRKTLSEETRQHQARAQYQDKLARQRYEDQLKQQQLLNEENLRKQEESVQKQEAMRRATVEREMELRHKNEMLRVEAEARARAKAERENADIIREQIRLKAAEHRQTVLESIRTAGTLFGEGFRAFVTDWDKVTATVAGLTLLAVGVYSAKNATLVAGRFIEARLGKPSLVRETSRITVLEALRHPIQVSRRLLSRPQDALEGVVLSPSLEARVRDIAIATRNTKKNRSLYRNILMYGPPGTGKTLFAKKLALHSGMDYAIMTGGDVAPMGREGVTAMHKLFDWANTSRRGLLLFVDEADAFLRKRATEKISEDLRATLNAFLYRTGQHSNKFMLVLASNQPEQFDWAINDRINEMVHFDLPGQEERERLVRMYFDKYVLKPATEGKQRLKLAQFDYGRKCSEVARLTEGMSGREIAQLAVSWQATAYASEDGVLTEAMMDTRVQDAVQQHQQKMCWLKAEGPGRGDEPSPS

SEQ ID NO: 219 - DNA, 3187 bp, Homo sapiens
cccagaccagcagaggcagcagccggagcagccgcagcctgcgccctctcccgcccgcccgccctccgcccgcccgcccgccctccgccgccctccacccgccccggggtctctttcccccttcctcctcctcctcctccacccccccttcctcctccgcccgcccgcggggcccccctcgccttcccgcccgcccctattgttccgcccccggcctcccgcccttccccttcccgcccgctccccttttcccctcagtcgcctcgcgcctgcagtttttggctttcacccccaaccagtgaccaaagacttgaccactcaaagtccagctccccagaacactgctcgacatggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagactctctcccagtcccccccgaagggcgtgaccatcccgtaccggcccaagccgtccagctctccggtcatctttgcaggtggtcaggacaggtacagcacaggcagcgacagtgcgagctttccccacaccaccccgtccatgtgcctcaaccctgacctggagggaccacctctagaggcctataccattcaaggacagtatgccattccacagccagatttgaccaagctgcaccagttggcaatgcaacagtctcattttcccatgacgcatggcaacaccggattcagtggcattgaatccagctctccagaggtgaaaggctattgggcaggtttggatgcatctgctcagactacttctcatgaactcaccattccaaacgatttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcaggctttcctcggagacgggtggcatggggagcagctagaacaatgcagattcatccataatccctttctgctgttcaccaccacccatgatccatctgtgtagtttctgaacagtcagcgattccaggttttaaatagtttgtaaattttcagtttctacacactttatcatccactcgtgattttttaattaaagcgttttaattcctttctctgttcagctgttgatgctgagatccatatttagttttataagcttctccctggttttttttttttggctcatgaatttttctgtttgtcatggaaatgtaagagtggaatattaatacatttcagtttagttctgtaatgtcaggaatttttcaaaaaaattaaaagatggactggagctttttctttgtgaatagaaactggatgccacagtgattcatgtgggttttattcctcttgtcttgctgttatttttgtaccttttatccctcaaaggacccttcttgggttttgaatggaagcctttattccggttaagatgttttcttctattttaccacttccatctttttttgtggccctcgatcctatttttccctgactccatgcttggttggcccttataaaacttgtgcccaaaagattgaggattagactttccgaggacttacctgtcctaggggagtaggcaagcacttccactagggagggggtgggggaaaggaatgacacatgacatacatggcatacacattaagcagttgatcatatgtctgactgggttccagtttcttgggaatgttggtccccttgttcaggcttgcatattttaaactaaaaatttcagtctattgtttttagtaacttcatttatagtcctccataacaagttagaaggatgtatctgctaccatttattcctataattttagaaagttggggcttgacattatactcatttagtgagagtagatgcaaaaaagtggaggggcaggagaacttctccagacacctcagataaagtccggagcccaaggctttatcttaaccatgtatggtaccccattcattcatcaagaaaaccctcaacagctgggcctgcatggagtgttatatttcaaggtttttcacaggggttacagtaggacagtccccaccccaatcaggcaccaggataaaagcagggacttaaacagcaccccggttcttcagcctgagccatcacatgctatcagtctcctaacctccccctgggccttaagacagggcttgggcagagaagataaatggtgggacaaaaaaatgagttacattgccacctgagaaacctcagaggggaggacccagccttagcctccctcctcccaagtgcaaaatgtgtaaacagagtaaacggaacagaaaagtgcagtctaagtggttttctctcctgcccctcccaccgcccctccccccaccccctattatttggggataaagaatataaagacaaccctggcttttctattgccttgttgcttgctgaatataaggaatggggtggggcaggaaggggcttgcccttagccacagctctacggctgtgcctcattcatttccacagctgccagtgtccctagagtttatcaggtgaattggtcaggggatcagtctccctcgagcctgacttacggctgggacagccccatctttctgttgattatgtggcgcatatatatatatatatgtatatatatataatttatataaatatttctctatgtaaaaaaaaaaaaaaaaa

SEQ ID NO: 220 - protein, 366 aa, Homo sapiens
MDTGVIEGGLNVTLTIRLLMHGKEVGSIIGKKGESVKKMREESGARINISEGNCPERIITLAGPTNAIFKAFAMIIDKLEEDISSSMTNSTAASRPPVTLRLVVPASQCGSLIGKGGCKIKEIRESTGAQVQVAGDMLPNSTERAITIAGIPQSIIECVKQICVVMLETLSQSPPKGVTIPYRPKPSSSPVIFAGGQDRYSTGSDSASFPHTTPSMCLNPDLEGPPLEAYTIQGQYAIPQPDLTKLHQLAMQQSHFPMTHGNTGFSGIESSSPEVKGYWAGLDASAQTTSHELTIPNDLIGCIIGRQGAKINEIRQMSGAQIKIANPVEGSTDRQVTITGSAASISLAQYLINVRLSSETGGMGSS

SEQ ID NO: 221 - DNA, 1709 bp, Homo sapiens
agaacactggcggccgatcccaacgaggctccctggagcccgacgcagagcagcgccctggccgggccaagcaggagccggcatcatggattccttcaaagtagtgctggaggggccagcaccttggggcttccggctgcaagggggcaaggacttcaatgtgcccctctccatttcccggctcactcctgggggcaaagcggcgcaggccggagtggccgtgggtgactgggtgctgagcatcgatggcgagaatgcgggtagcctcacacacatcgaagctcagaacaagatccgggcctgcggggagcgcctcagcctgggcctcagcagggcccagccggttcagagcaaaccgcagaaggcctccgcccccgccgcggaccctccgcggtacacctttgcacccagcgtctccctcaacaagacggcccggccctttggggcgcccccgcccgctgacagcgccccgcagcagaatggacagccgctccgaccgctggtcccagatgccagcaagcagcggctgatggagaacacagaggactggcggccgcggccggggacaggccagtcgcgttccttccgcatccttgcccacctcacaggcaccgagttcatgcaagacccggatgaggagcacctgaagaaatcaagccaggtgcccaggacagaagccccagccccagcctcatctacaccccaggagccctggcctggccctaccgcccccagccctaccagccgcccgccctgggctgtggaccctgcgtttgccgagcgctatgccccggacaaaacgagcacagtgctgacccggcacagccagccggccacgcccacgccgctgcagagccgcacctccattgtgcaggcagctgccggaggggtgccaggagggggcagcaacaacggcaagactcccgtgtgtcaccagtgccacaaggtcatccggggccgctacctggtggcgctgggccacgcgtaccacccggaggagtttgtgtgtagccagtgtgggaaggtcctggaagagggtggcttctttgaggagaagggcgccatcttctgcccaccatgctatgacgtgcgctatgcacccagctgtgccaagtgcaagaagaagattacaggcgagatcatgcacgccctgaagatgacctggcacgtgcactgctttacctgtgctgcctgcaagacgcccatccggaacagggccttctacatggaggagggcgtgccctattgcgagcgagactatgagaagatgtttggcacgaaatgccatggctgtgacttcaagatcgacgctggggaccgcttcctggaggccctgggcttcagctggcatgacacctgcttcgtctgtgcgatatgtcagatcaacctggaaggaaagaccttctactccaagaaggacaggcctctctgcaagagccatgccttctctcatgtgtgagccccttctgcccacagctgccgcggtggcccctagcctgaggggcctggagtcgtggccctgcatttctgggtagggctggcaatggttgccttaaccctggctcctggcccgagcctggggctccctgggccctgccccacccaccttatcctcccaccccactccctccaccaccacagcacaccggtgctggccacaccagccccctttcacctccagtgccacaataaacctgtacccagctgtg

SEQ ID NO: 222 - protein, 457 aa, Homo sapiens
MDSFKVVLEGPAPWGFRLQGGKDFNVPLSISRLTPGGKAAQAGVAVGDWVLSIDGENAGSLTHIEAQNKIRACGERLSLGLSRAQPVQSKPQKASAPAADPPRYTFAPSVSLNKTARPFGAPPPADSAPQQNGQPLRPLVPDASKQRLMENTEDWRPRPGTGQSRSFRILAHLTGTEFMQDPDEEHLKKSSQVPRTEAPAPASSTPQEPWPGPTAPSPTSRPPWAVDPAFAERYAPDKTSTVLTRHSQPATPTPLQSRTSIVQAAAGGVPGGGSNNGKTPVCHQCHKVIRGRYLVALGHAYHPEEFVCSQCGKVLEEGGFFEEKGAIFCPPCYDVRYAPSCAKCKKKITGEIMHALKMTWHVHCFTCAACKTPIRNRAFYMEEGVPYCERDYEKMFGTKCHGCDFKIDAGDRFLEALGFSWHDTCFVCAICQINLEGKTFYSKKDRPLCKSHAFSHV

SEQ ID NO: 223 - DNA, 1151 bp, Homo sapiens
gataatgccaggccctgcccccggcagaggcggaagcggagtcggcctgagaggtctctcgtcgctgcaggcgcctcagcccagccgcgtgccttggcccatggccgcctactcttaccgccccggccctggggccggccctgggcctgctgcaggcgcggcgctgccggaccagagcttcctgtggaacgttttccagagggtcgataaagacaggagtggagtgatatcagacaccgagcttcagcaagctctctccaacggcacgtggactccctttaatccagtgactgtcaggtcgatcatatccatgtttgaccgtgagaacaaggccggcgtgaacttcagcgagttcacgggtgtgtggaagtacatcacggactggcagaacgtcttccgcacgtacgaccgggacaactccgggatgatcgataagaacgagctgaagcaggccctctcaggtttcggctaccggctctctgaccagttccacgacatcctcattcgaaagtttgacaggcagggacgggggcagattgccttcgacgacttcatccagggctgcatcgtcctgcagaggttgacggatatattcagacgttacgacacggatcaggacggctggattcaggtgtcgtacgaacagtacctgtccatggtcttcagtatcgtatgaccctggcctctcgtgaagagcagcacaacatggaaagagccaaaatgtcacagttcctatctgtgagggaatggagcacaggtgcagttagatgctgttcttcctttagattttgtcacgtggggacccagctgtacatatgtggataagctgattaatggttttgcaactgtaatagtagctgtatcgttctaatgcagacattggatttggtgactgtctcattgtgccatgaggtaaatgtaatgtttcaggcattctgcttgcaaaaaaatctatcatgtgcttttctagatgtctctggttctatagtgcaaatgcttttattagccaataggaattttaaaataacatggaacttacacaaaaggcttttcatgtgccttacttttttaaaaaggagtttattgtattcattggaatatgtgacgtaagcaataaagggaatgttagacgtgtaaaaaaaaaaaaaaaa

SEQ ID NO: 224 - protein, 191 aa, Homo sapiens
MAAYSYRPGPGAGPGPAAGAALPDQSFLWNVFQRVDKDRSGVISDTELQQALSNGTWTPFNPVTVRSIISMFDRENKAGVNFSEFTGVWKYITDWQNVFRTYDRDNSGMIDKNELKQALSGFGYRLSDQFHDILIRKFDRQGRGQIAFDDFIQGCIVLQRLTDIFRRYDTDQDGWIQVSYEQYLSMVFSIV

SEQ ID NO: 225 - DNA, 3944 bp, Homo sapiens
gagctcaccgctgccagtcgcgctgcctgcccgtcccacccttttcgtgcaggcattcagctaaatgacgggcggagcccggcggcggcttccggtcgggggaaaaaagttgggccgaaggaggggccgggaagacgcaagaggaagaagagaaaacggccgggcggcggtggctgtaggttgtgcggctgcagcggctcttccctgggcggacgatggacagccagggcaggaaggtggtggtgtgcgacaacggcaccgggtttgtgaagtgtggatatgcaggctctaactttccagaacacatcttcccagctttggttggaagacctattatcagatcaaccaccaaagtgggaaacattgaaatcaagaataacaaaaagatggatcttatggttggtgatgaggcaagtgaattacgatcaatgttagaagttaactaccctatggaaaatggcatagtacgaaattgggatgacatgaaacacctgtgggactacacatttggaccagagaaacttaatatagataccagaaattgtaaaatcttactcacagaacctcctatgaacccaaccaaaaacagagagaagattgtagaggtaatgtttgaaacttaccagttttccggtgtatatgtagccatccaggcagttctgactttgtacgctcaaggtttattgactggtgtagtggtagactctggagatggtgtgactcacatttgcccagtatatgaaggcttttctctccctcatcttaccaggagactggatattgctgggagggatataactagatatcttatcaagctacttctgttgcgaggatacgccttcaaccactctgctgattttgaaacggttcgcatgattaaagaaaaactgtgttacgtgggatataatattgagcaagagcagaaactggccttagaaaccacagtattagttgaatcttatacactcccagatggacgtatcatcaaagttgggggagagagatttgaagcaccagaagctttatttcagcctcacttgatcaatgttgaaggagttggtgttgctgaattgctttttaacacaattcaggcagctgacattgataccagatctgaattctacaaacacattgtgctttctggagggtctactatgtatcctggcctgccatcacggttggaacgagaacttaaacagctttacttagaacgagttttgaagggtgatgtggaaaaactttctaaatttaagatccgcattgaagacccaccccgcagaaagcacatggtattcctgggtggtgcagttctagcggatatcatgaaagacaaagacaacttttggatgacccgacaagagtaccaagaaaagggtgtccgtgtgctagagaaacttggtgtgactgttcgataaactccaaagcttgttcccgtcatacccgtaatgctttcttttttcctttattgccaatctttgaactcattcaactccaggacatggaagaggcctctctctgccctttgactggaaaggtcaagttttattctggtgtcttggggaagctttgttaaatttttgttaatgtgggtaaatctgagtttaattcaactgcttccctacatagactagagggctaaggattctgtctgctgctttgtttcttctaagtaggcatttagatcattcctataggcttcctattttcactttactgctctaatgctgctagtcgtagtctttagcacactaggtggtatgcctttattagcataaaacaaaaaaaactttaacaggagcttttacatattactgggatggggggtggttcgggatgggtgggcagctgctgaaccctttagggcatttcctctgtaatgtggcgctttcaactgtactgctgcagctttaagtaccttaaagcttctcctgtgaacttcttagggaaatgttaggttcagaactaaagtgttttgggtgggttttgttgcgggggggagggtaacaatgggtggtcttctgatttttatttttgaggttttgtcaactggagtacgtagaggaactttatttacagtactttgatttggcaggttttcttctacttgtgctctgcctggagctgtttccatatgatataaaaagcaagtgtagtattccattactatgtggcttagggatttatttgttttttaaaatcaaccatgttagctgggattagactccctacagtccttcaatggaaaagtaacatttaaaaatcctttgggtaattcgaattacagatttaaaagagcttaagatctggtgttttgttaatgcttctgtttattccagaagcattaaggtaacccattgccaagtatcattcttgcaaattattcttttatataactgaccagtgcttaataaaacaagcaggtacttacaaataattactggcagtaggttataattggtggtttaaaaataacattggaatacaggacttgttgccaattgggtaattttcattagttgttttgtttgttttgatttgaaacctggaaatacagtaaaatttgactgtttaaaatgttggccaaaaaaatcaagatttaatttttttatttgtactgaaaaactaatcataactgttaattctcagccatctttgaagcttgaaagaagagtctttggtattttgtaaacgttagcagactttcctgccagtgtcagaaaatcctatttatgaatcctgtcggtattccttggtatctgaaaaaaataccaaatagtaccatacatgagttatttctaagtttgaaaaataaaaagaaattgcatcacactaattacaaaatacaagttctggaaaaaatatttttcttcattttaaaacttttttttaactaataatagctttgaaagaagaggcttaatttgggggtggtaactaaaatcaaaagaaatgattgacttgagggtctctgtttggtaagaatacatcattagcttaaataagcagcagaaggttagttttaattatgtagcttctgttaatattaagtgttttttgtctgttttacctcaatttgaacagataagtttgcctgcatgctggacatgcctcagaaccctgaatagcccgtactagatcttgggaacatggatcttagagtcactttggaataagttcttatataaatacccccagccttttgagaacggggcttgttaaaggacgcgtatgtagggcccgtacctactggcagttgggttcagggaaatgggattgacttggccttcaggctcctttggtcataattttaaaatatgggagtagaaaacaacaaagaatggaatggactcttaaaacaatgaaagagcatttatcgtttgtcccttgaatgtagaatttgtttttgatttcataattctgctggtaaatgtgacagttaaaatggtgcattatgtatatatattataatttagaaataccattttataattttactattccagggtgacataatgcatttaaatttgggatttgggtggagtattatgtttaactggagttgtcaagtatgagtccctcaggaaaaaaaaaaaattctgttttaaaaagcaatctgattcttagctcttgaaactattgctacttaaatttccaataattaaaaatttaaaatttttaaattagaattgccaatacttctacatttgagaagggtttttttagaaatacatttagtaaagtccccaagacattagtcttacatttaaacttttttctttaaaacatggttttggtggttaacttttacacagttctgagtactgttaatatctggaaagtatcttgagatatcagtggaaagctaaacagtctaaattaacatgaaatacttcattttgattgagaaaataaaatcagattttttcaaagtcaaaaaaaaaaaa

SEQ ID NO: 226 - protein, 399 aa, Homo sapiens
MDSQGRKVVVCDNGTGFVKCGYAGSNFPEHIFPALVGRPIIRSTTKVGNIEIKNNKKMDLMVGDEASELRSMLEVNYPMENGIVRNWDDMKHLWDYTFGPEKLNIDTRNCKILLTEPPMNPTKNREKIVEVMFETYQFSGVYVAIQAVLTLYAQGLLTGVVVDSGDGVTHICPVYEGFSLPHLTRRLDIAGRDITRYLIKLLLLRGYAFNHSADFETVRMIKEKLCYVGYNIEQEQKLALETTVLVESYTLPDGRIIKVGGERFEAPEALFQPHLINVEGVGVAELLFNTIQAADIDTRSEFYKHIVLSGGSTMYPGLPSRLERELKQLYLERVLKGDVEKLSKFKIRIEDPPRRKHMVFLGGAVLADIMKDKDNFWMTRQEYQEKGVRVLEKLGVTVR

SEQ ID NO: 227 - DNA, 2412 bp, Homo sapiens
agtgctagtggcggcaggtgcaggtggccgcgcggcatcctggggcttgcagtctcccgagcgttctgttgtgtccctgcctacaattttagggaacctaataaaagggtggtcggtatgtttttatttgggtgtgtacttttgttaggtcgctttttcgctatgcattaagtacggactttaggactcaactagtaccaggaagaaaaagaccggacattttcacctgtttgttatacagcgaaggggaaaaattgggaagaaatcctcaagctacaagaaaaataaccagaagctttacactttagcctgcagtgacttatatcctggtgtcctaagtccacctaagtcagttttgcaataagaggtcccaagtttggttttcttggagcttgcatcagttggttgcatcatccctgagtagaagatttgcggttgcaaggaaaaataaggtacagagcttctccagcgggaaagtgcatgtctgcacggcacgagcccacgcaccgcagaacaggcttgccaggtctcctcagagaccctcgcaggaacctaacaatgaaatccagttgtccagtcttgatttgtggaggggtaaggagaatccgaggccagtgggcaatccgcccactgttgggagcgactgacctcacgaatcaataatttgcttttgactaggaagtgcagcggttcttggggggaggggctggactgggtggcggacgcgaggagcaacggttctcccgaacctctcccccgcccctactatcttggcctacattttcccgctccgtcccgggacctggacacccagaatccacgaaaagcaactcgcgctcgagaacagctctcgtacccttctacgtgatctgcacctttaagctcactccatcccaaaccggaccccggaggcaccacccacatccgtctaacatcacttccttcagagtttgaaaaaaaaaaatctgggaagtagaggtgttgtgctgagcggcgctcggcgaactgtgtggaccgtctgctgggactccggccctgcgtccgctcagccccgtggccccgcgcacctactgccatggagacgcggcctcgtctcggggccacctgtttgctgggcttcagtttcctgctcctcgtcatctcttctgatggacataatgggcttggaaagggttttggagatcatattcattggaggacactggaagatgggaagaaagaagcagctgccagtggactgcccctgatggtgattattcataaatcctggtgtggagcttgcaaagctctaaagcccaaatttgcagaatctacggaaatttcagaactctcccataattttgttatggtaaatcttgaggatgaagaggaacccaaagatgaagatttcagccctgacgggggttatattccacgaatcctttttctggatcccagtggcaaggtgcatcctgaaatcatcaatgagaatggaaaccccagctacaagtatttttatgtcagtgccgagcaagttgttcaggggatgaaggaagctcaggaaaggctgacgggtgatgccttcagaaagaaacatcttgaagatgaattgtaacatgaatgtgccccttctttcatcagagttagtgttctggaaggaaagcagcagggaagggaatattgaggaatcatctagaacaattaagccgaccaggaaacctcattcctacctacactggaaggagcgctctcactgtggaagagttctgctaacagaagctggtctgcatgtttgtggatccagcggagagtggcagactttcttctccttttccctctcacctaaatgtcaacttgtcattgaatgtaaagaatgaaaccttctgacacaaaacttgagccacttggatgtttactcctcgcacttaagtatttgagtcttttcccatttcctcccactttactcaccttagtggtgaaaggagactagtagcatcttttctacaacgttaaaattgcagaagtagcttatcattaaaaaacaacaacaacaacaataacaataaatcctaagtgtaaatcagttattctaccccctaccaaggatatcagcctgttttttcccttttttctcctgggaataattgtgggcttcttcccaaatttctacagcctctttcctcttctcatgcttgagcttccctgtttgcacgcatgcgtgtgcaggactggctgtgtgcttggactcggctccaggtggaagcatgctttcccttgttactgttggagaaactcaaaccttcaagccctaggtgtagccattttgtcaagtcatcaactgtatttttgtactggcattaacaaaaaaagagataaaatattgtaccattaaactttaataaaactttaaaaggaaaaaaaaaaaaaaaaaaa

SEQ ID NO: 228 - protein, 172 aa, Homo sapiens
METRPRLGATCLLGFSFLLLVISSDGHNGLGKGFGDHIHWRTLEDGKKEAAASGLPLMVIIHKSWCGACKALKPKFAESTEISELSHNFVMVNLEDEEEPKDEDFSPDGGYIPRILFLDPSGKVHPEIINENGNPSYKYFYVSAEQVVQGMKEAQERLTGDAFRKKHLEDEL

SEQ ID NO: 229 - DNA, 2146 bp, Homo sapiens
ccaccctgggcccgcccccggctccatcttgcgggagaccgggttgggctgtgacgctgctgctggggtcagaatgtcatacccaggctatcccccaacaggctacccacctttccctggatatcctcctgcaggtcaggagtcatcttttcccccttctggtcagtatccttatcctagtggctttcctccaatgggaggaggtgcctacccacaagtgccaagtagtggctacccaggagctggaggctaccctgcgcctggaggttatccagcccctggaggctatcctggtgccccacagccagggggagctccatcctatcccggagttcctccaggccaaggatttggagtcccaccaggtggagcaggcttttctgggtatccacagccaccttcacagtcttatggaggtggtccagcacaggttccactacctggtggctttcctggaggacagatgccttctcagtatcctggaggacaacctacttaccctagtcagcctgccacagtgactcaggtcactcaaggaactatccgaccagctgccaacttcgatgctataagagatgcagaaattcttcgtaaggcaatgaagggttttgggacagatgagcaggcaattgtggatgtggtggccaaccgttccaatgatcagaggcaaaaaattaaagcagcatttaagacctcctatggcaaggatttaatcaaagatctcaaatcagagttaagtggaaatatggaagaactgatcctggccctcttcatgcctcctacgtattacgatgcctggagcttacggaaagcaatgcagggagcaggaactcaggaacgtgtattgattgagattttgtgcacaagaacaaatcaggaaatccgagaaattgtcagatgttatcagtcagaatttggacgagaccttgaaaaggacattaggtcagatacatcaggacattttgaacgtttacttgtgtccatgtgccagggaaatcgtgatgagaaccagagtataaaccaccaaatggctcaggaagatgctcagcgtctctatcaagctggtgaggggagactagggaccgatgaatcttgctttaacatgatccttgccacaagaagctttcctcagctgagagctaccatggaggcttattctaggatggctaatcgagacttgttaagcagtgtgagccgtgagttttccggatatgtagaaagtggtttgaagaccatcttgcagtgtgccctgaaccgccctgccttctttgctgagaggctctactatgctatgaaaggtgctggcacagatgactccaccctggtccggattgtggtcactcgaagtgagattgaccttgtacaaataaaacagatgttcgctcagatgtatcagaagactctgggcacaatgattgcaggtgacacgagtggagattaccgaagacttcttctggctattgtgggccagtaggagggatttttttttttttaatgaaaaaaaatttctattcatagcttatccttcagagcaatgacctgcatgcagcaatatcaaacatcagctaaccgaaagagctttctgtcaaggaccgtatcagggtaatgtgcttggtttgcacatgttgttattgccttaattctaattttattttgttctctacatacaatcaatgtaaagccatatcacaatgatacagtaatattgcaatgtttgtaaaccttcattcttactagtttcattctaatcaagatgtcaaattgaataaaaatcacagcaatctctgattctgtgtaataatattgaataattttttagaaggttactgaaagctctgccttccggaatccctctaagtctgcttgatagagtggatagtgtgttaaaactgtgtactttaaaaaaaaattcaacctttacatctagaataatttgcatctcattttgcctaaattggttctgtattcataaacactttccacatagaaaatagattagtattacctgtggcaccttttaagaaagggtcaaatgtttatatgcttaagatacatagcctacttttttttcgcagttgttttctttttttaaattgagttatgacaaataaaaaattgcatatatttaaggtgtacaaaaaaaaaa

SEQ ID NO: 230 - protein, 466 aa, Homo sapiens
MSYPGYPPTGYPPFPGYPPAGQESSFPPSGQYPYPSGFPPMGGGAYPQVPSSGYPGAGGYPAPGGYPAPGGYPGAPQPGGAPSYPGVPPGQGFGVPPGGAGFSGYPQPPSQSYGGGPAQVPLPGGFPGGQMPSQYPGGQPTYPSQPATVTQVTQGTIRPAANFDAIRDAEILRKAMKGFGTDEQAIVDVVANRSNDQRQKIKAAFKTSYGKDLIKDLKSELSGNMEELILALFMPPTYYDAWSLRKAMQGAGTQERVLIEILCTRTNQEIREIVRCYQSEFGRDLEKDIRSDTSGHFERLLVSMCQGNRDENQSINHQMAQEDAQRLYQAGEGRLGTDESCFNMILATRSFPQLRATMEAYSRMANRDLLSSVSREFSGYVESGLKTILQCALNRPAFFAERLYYAMKGAGTDDSTLVRIVVTRSEIDLVQIKQMFAQMYQKTLGTMIAGDTSGDYRRLLLAIVGQ

SEQ ID NO: 231 - DNA, 3536 bp, Homo sapiens
gtcccagggggcggggcagaggaaaaggcgccggccccacagtgctccccgcttccgcccagtccagcccgggccggctgaccgggtccgacacagtctcctggaccaggctccctccatcctcacccctcccccagcttcccgccgccactcaccgaaccggaaccggctgccatgcgaaggggtttccggccgggcgcggaacgcaaaacccgggaaccgccgcgaaccggaaccgccttcacagcaccggaagagtcgctaggaggcagccatgcataaagacgagtttcatctgaaatttttcatgtgtgtgattcagtctcgccagttagtcaggactcctcagagaacagctggggaagcttctacttccagcatgctcataccaaagccaccaccaaagacagacatcttgaagagtctagatactatggatgatccagacaccgtgggaagcatacctgttttcaaaactgagtggatcatgacccatgaagagcaccatgcagccaaaaccctggggattggcaaagccattgctgtcttaacctctggtggagatgcccaaggtatgaatgctgctgtcagggctgtggttcgagttggtatcttcaccggtgcccgtgtcttctttgtccatgagggttatcaaggcctggtggatggtggagatcacatcaaggaagccacctgggagagcgtttcgatgatgcttcagctgggaggcacggtgattggaagtgcccggtgcaaggactttcgggaacgagaaggacgactccgagctgcctacaacctggtgaagcgtgggatcaccaatctctgtgtcattgggggtgatggcagcctcactggggctgacaccttccgttctgagtggagtgacttgttgagtgacctccagaaagcaggtaagatcacagatgaggaggctacgaagtccagctacctgaacattgtgggcctggttgggtcaattgacaatgacttctgtggcaccgatatgaccattggcactgactctgccctgcatcggatcatggaaattgtagatgccatcactaccactgcccagagccaccagaggacatttgtgttagaagtaatgggccgccactgtggatacctggcccttgtcacctctctgtcctgtggggccgactgggtttttattcctgaatgtccaccagatgacgactgggaggaacacctttgtcgccgactcagcgagacaaggacccgtggttctcgtctcaacatcatcattgtggctgagggtgcaattgacaagaatggaaaaccaatcacctcagaagacatcaagaatctggtggttaagcgtctgggatatgacacccgggttactgtcttggggcatgtgcagaggggtgggacgccatcagcctttgacagaattctgggcagcaggatgggtgtggaagcagtgatggcacttttggaggggaccccagataccccagcctgtgtagtgagcctctctggtaaccaggctgtgcgcctgcccctcatggaatgtgtccaggtgaccaaagatgtgaccaaggccatggatgagaagaaatttgacgaagccctgaagctgagaggccggagcttcatgaacaactgggaggtgtacaagcttctagctcatgtcagacccccggtatctaagagtggttcgcacacagtggctgtgatgaacgtgggggctccggctgcaggcatgaatgctgctgttcgctccactgtgaggattggccttatccagggcaaccgagtgctcgttgtccatgatggtttcgagggcctggccaaggggcagatagaggaagctggctggagctatgttgggggctggactggccaaggtggctctaaacttgggactaaaaggactctacccaagaagagctttgaacagatcagtgccaatataactaagtttaacattcagggccttgtcatcattgggggctttgaggcttacacagggggcctggaactgatggagggcaggaagcagtttgatgagctctgcatcccatttgtggtcattcctgctacagtctccaacaatgtccctggctcagacttcagcgttggggctgacacagcactcaatactatctgcacaacctgtgaccgcatcaagcagtcagcagctggcaccaagcgtcgggtgtttatcattgagactatgggtggctactgtggctacctggctaccatggctggactggcagctggggccgatgctgcctacatttttgaggagcccttcaccattcgagacctgcaggcaaatgttgaacatctggtgcaaaagatgaaaacaactgtgaaaaggggcttggtgttaaggaatgaaaagtgcaatgagaactataccactgacttcattttcaacctgtactctgaggaggggaagggcatcttcgacagcaggaagaatgtgcttggtcacatgcagcagggtgggagcccaaccccatttgataggaattttgccactaagatgggcgccaaggctatgaactggatgtctgggaaaatcaaagagagttaccgtaatgggcggatctttgccaatactccagattcgggctgtgttctggggatgcgtaagagggctctggtcttccaaccagtggctgagctgaaggaccagacagattttgagcatcgaatccccaaggaacagtggtggctgaaactgaggcccatcctcaaaatcctagccaagtacgagattgacttggacacttcagaccatgcccacctggagcacatcacccggaagcggtccggggaagctgccgtctaaacctctctggagtgaggggaatagattacctgatcatggtcagctcacaccctaataagtccacatcttctcagtgttttagctgtttttttcattaggtttccttttattctgtaccttgcagccatgaccagttctggccaggagctggaggagcaggcagtgggtgggagctccttttaggtagaatttaacatgacttctgccccagctttatctgtcacacaaggctgggcacctctagtgctactgctagatatcacttactcagttagaattttcctaaaaataagctttatttatttctttgtgataacaaagagtcttggttcctctactacttttactacagtgacaaattgtaactacactaataaatgccaactggtcactgtgcttttgcttctcctgttatcatcttcctaagtggaatgtaatactgtcagccccatgtatcagacacttgtctgatgaagcagtaaagacgttaagggtatcacagggggtggaggaagggattatctctagtacactacttgctggctgtctgaaaaattgtcactgccaaactctaaaaacagttctaaatagtgactgagaaggtttgttgctggagtcagggaataaggcagccaaatactctttgcacagttctttagtgggaagagaaattaacaataaatatcaagcactgtgaaaaaaaaaa

SEQ ID NO: 232 - protein, 851 aa, Homo sapiens
MHKDEFHLKFFMCVIQSRQLVRTPQRTAGEASTSSMLIPKPPPKTDILKSLDTMDDPDTVGSIPVFKTEWIMTHEEHHAAKTLGIGKAIAVLTSGGDAQGMNAAVRAVVRVGIFTGARVFFVHEGYQGLVDGGDHIKEATWESVSMMLQLGGTVIGSARCKDFREREGRLRAAYNLVKRGITNLCVIGGDGSLTGADTFRSEWSDLLSDLQKAGKITDEEATKSSYLNIVGLVGSIDNDFCGTDMTIGTDSALHRIMEIVDAITTTAQSHQRTFVLEVMGRHCGYLALVTSLSCGADWVFIPECPPDDDWEEHLCRRLSETRTRGSRLNIIIVAEGAIDKNGKPITSEDIKNLVVKRLGYDTRVTVLGHVQRGGTPSAFDRILGSRMGVEAVMALLEGTPDTPACVVSLSGNQAVRLPLMECVQVTKDVTKAMDEKKFDEALKLRGRSFMNNWEVYKLLAHVRPPVSKSGSHTVAVMNVGAPAAGMNAAVRSTVRIGLIQGNRVLVVHDGFEGLAKGQIEEAGWSYVGGWTGQGGSKLGTKRTLPKKSFEQISANITKFNIQGLVIIGGFEAYTGGLELMEGRKQFDELCIPFVVIPATVSNNVPGSDFSVGADTALNTICTTCDRIKQSAAGTKRRVFIIETMGGYCGYLATMAGLAAGADAAYIFEEPFTIRDLQANVEHLVQKMKTTVKRGLVLRNEKCNENYTTDFIFNLYSEEGKGIFDSRKNVLGHMQQGGSPTPFDRNFATKMGAKAMNWMSGKIKESYRNGRIFANTPDSGCVLGMRKRALVFQPVAELKDQTDFEHRIPKEQWWLKLRPILKILAKYEIDLDTSDHAHLEHITRKRSGEAAV

SEQ ID NO: 233 - DNA, 3522 bp, Homo sapiens
gccccatcacgtgaccgcagccccagcgcggcggggccggcgtctcctggctgccgtcacttccggttctctgtcagtcgcgagcgaacgaccaagagggtgttcgactgctagagccgagcgaagcgatgcctaaatcaaaggaacttgtttcttcaagctcttctggcagtgattctgacagtgaggttgacaaaaagttaaagaggaaaaagcaagttgctccagaaaaacctgtaaagaaacaaaagacaggtgagacttcgagagccctgtcatcttctaaacagagcagcagcagcagagatgataacatgtttcagattgggaaaatgaggtacgttagtgttcgcgattttaaaggcaaagtgctaattgatattagagaatattggatggatcctgaaggtgaaatgaaaccaggaagaaaaggtatttctttaaatccagaacaatggagccagctgaaggaacagatttctgacattgatgatgcagtaagaaaactgtaaaattcgagccatataaataaaacctgtactgttctagttgttttaatctgtctttttacattggcttttgttttctaaatgttctccaagctattgtatgtttggattgcagaagaatttgtaagatgaatacttttttttaatgtgcattattaaaaatattgagtgaagctaattgtcaactttattaaggattactttgtctgcccaccacctagtgtaaaataaaatcaagtaatacaatcttaactgttgtggccttttttgatcataagagttggtactgtttaaggccaaaagtaacagtttttatagatcttttagtttcaactcagcttttacaataaaaaggatttgtattgcattgagtttataaacttttggtttgtgaacttcatatttgatcttttctcttccaatcaaatgtctaggcttgtttgacttccacccccaatggtttttcactctttttatttacttcattttcctttaataacttaatctcttcatgttcagtttttacttcactctttattcttttctttgattatggtatgcttatttggaaagtcagtgaaactgtcaaaatgttatctcaataagatacttatatgagaactacaatcaccgaatctactgtattcaatattagcagatctaatttgataaacaacatggcttgtgtgaaaactgagcaggtgtttgtttacccatagtgttctgtgtagttattgcttagtctgcagaaaataatgacttagatgagatgtctgacttgctttcacttattaaacatgttcaccatgggatgatgtctgtaacatcagatattgttcaactagactaggatttaataaaaattgtgaaagcttactggcctaacattttattttataatattgggtatgaattatatgtagccagagatgtcattaagctttactgttatagtaggtaatatggttagtttgtagggaaaagagcatatgagcacatgcttgtgtattttggcctttgccccagtagaacagaccaatggcattctagacttgatgatactaagttttagcagacactagtaagtggtttgtatttaaccatactgatgaagcagacagattgaggcacagattttagtggctttgtggcaataaatagggcatggtgtgccttaggaaaagaatgtttataaagggaattataactgaaattaaaggaggcggcagtgaagaggaaataattctcttctatctaaatgatatacatatgatattttgagatttttataacagcagtggaacacaattctaggtagagtagaaaaaggaaagttttaaagacatataaaagattcttgttgacaaattatttttggtagcaaatctcaaatggttacctgctattaaggtctgccatattagagttttgcactattttgctaccaagtttgattcatacatctaaaacattttgtagttacttgtcaaggacttaatttgaaaatcatttgccaggccacatagttatcaatttttttttctatcagctattctgttgtatttctaaaacattttttagatgactttttaaagtatatttagcagtaaccttatgaggttcaaattggtaaatctcttgtaatttagccttcatcgaataataggtaccagtgtattaaaaatgtgtattttttgcagccccttgaaccagagtaggttcagagaaactcccaaagtttgtactttagacacatcatgcttgattggtaacttccctccttttttggggaacatgtttgtgtcctattaacttaattggatagatttttaaatatttcttatttttggcacacggaaagggtagttcgagtacagaactttgatttttggtgtagatgcagagggaatgatgggtaaatttcctaggtttatgtgaatttagggggtgtatgcattttgaaacaatctactaacagatggtgctgaaatctattacctacatgttttctagttgttcagcattatgttaatgaagcctccatataaggagtgtttctctggcacagttggtaagttgactgctaacttcatttaaatgtgttactggatatgcagtatactgaaattattaatcagtttgtgtataggaaaagagaactgggttaaaagcaaattaacttgttctgaaaagaaagtatagattaattttgttttctgtttaaattttatctccttggtaaagatttttttttcctgggcagaaaacttggcatttttaggcgtagataccttaccttacaatgccaaaatgaatttaattccagtactcaggtttttccctttaacagactctatgtgtatcagggctttctaatgggtttttcctcttcgtttttaaaatgtgagtagcatttgaccaatttccagtgctcttagcattttacttaaagaacaaccactacaaaagaaaatctttgtaatttgattgtcttttgctttgcttcattaatgcctaagaacttaagaatactcctacctcattagctactcaagatgctgtgacgatcaaatctattctacataatgcgtttagaaacaaagacttgggtgaaaaatgaaataagtatattctgacttggctattgaggggaaaattcagtattaagtgttcctcacaggagatatgttagcagaatactataaaagtttgaaatttttaaaaagtaaaagtacttaaatttaggtatctctcctgaaattctttgcagttcattttttatggcagttaatccagtgaaacactcaaaagtttttttttttttaaaagtgtttttccagataaactgtagggtgaacattcacataatcacaaatatgtaattctgtaattgtggaatgcttgtatgctttgttttcgtacatcttccatggagatgtctgaatataatactccatctgtgaatattttaaatgttgaaataaaagtaagaaatgtgaaaaaaaaaaaaaaa

SEQ ID NO: 234 - protein, 127 aa, Homo sapiens
MPKSKELVSSSSSGSDSDSEVDKKLKRKKQVAPEKPVKKQKTGETSRALSSSKQSSSSRDDNMFQIGKMRYVSVRDFKGKVLIDIREYWMDPEGEMKPGRKGISLNPEQWSQLKEQISDIDDAVRKL

SEQ ID NO: 235 - DNA, 3581 bp, Homo sapiens
atacgtggctgccgtctgtccccgctgaggaggtgcagcagccggagatggcggcggtgctgaacgcagagcgactcgaggtgtccgtcgacggcctcacgctcagcccggacccggaggagcggcctggggcggagggcgccccgctgctgccgccaccgctgccaccgccctcgccacctggatccggtcgcggcccgggcgcctcaggggagcagcccgagcccggggaggcggcggctgggggcgcggcggaggaggcgcggcggctggagcagcgctggggtttcggcctggaggagttgtacggcctggcactgcgcttcttcaaagaaaaagatggcaaagcatttcatccaacttatgaagaaaaattgaagcttgtggcactgcataagcaagttcttatgggcccatataatccagacacttgtcctgaggttggattctttgatgtgttggggaatgacaggaggagagaatgggcagccctgggaaacatgtctaaagaggatgccatggtggagtttgtcaagctcttaaataggtgttgccatctcttttcaacatatgttgcgtcccacaaaatagagaaggaagagcaagaaaaaaaaaggaaggaggaagaggagcgaaggcggcgtgaagaggaagaaagagaacgtctgcaaaaggaggaagagaaacgtaggagagaagaagaggaaaggcttcgacgggaggaagaggaaaggagacggatagaagaagaaaggcttcggttggagcagcaaaagcagcagataatggcagctttaaactcccagactgccgtgcagttccagcagtatgcagcccaacagtatccagggaactacgaacagcagcaaattctcatccgccagttgcaggagcaacactatcagcagtacatgcagcagttgtatcaagtccagcttgcacagcaacaggcagcattacagaaacaacaggaagtagtagtggctgggtcttccttgcctacatcatcaaaagtgaatgcaactgtaccaagtaatatgatgtcagttaatggacaggccaaaacacacactgacagctccgaaaaagaactggaaccagaagctgcagaagaagccctggagaatggaccaaaagaatctcttccagtaatagcagctccatccatgtggacacgacctcagatcaaagacttcaaagagaagattcagcaggatgcagattccgtgattacagtgggccgaggagaagtggtcactgttcgagtacccacccatgaagaaggatcatatctcttttgggaatttgccacagacaattatgacattgggtttggggtgtattttgaatggacagactctccaaacactgctgtcagcgtgcatgtcagtgagtccagcgatgacgacgaggaggaagaagaaaacatcggttgtgaagagaaagccaaaaagaatgccaacaagcctttgctggatgagattgtgcctgtgtaccgacgggactgtcatgaggaggtgtatgctggcagccatcaatatccagggagaggagtctatctcctcaagtttgacaactcctactctttgtggcggtcaaaatcagtctactacagagtctattatactagataaaaatgttgttacaaagtctggagtctagggttgggcagaagatgacatttaatttggaaatttctttttacttttgtggagcattagagtcacagtttaccttattgatattggtctgatggtttgtgaactcttgctgggaatcaaaatttccttgagactctttagcattcatactttggggttaaaggagattcctcagactcatccagcccttgggtgctgaccagcagagtcactagtggatgctgaagttacatgagctacatgttaaatatttaaagtctccaaaataaaacaccccaacgttgaccttacccggctgatggttagccccttgctgcctgctccatgtgtcttatgagagcccgtagttacagtgtcctctaatttgaaatccataagttaacaagtctatatcaggtgcagctggctttgattaaaggccatttttaaaacttaaaaactcaacacctcacagattataatagaaaaagaaatggcctcagtttgatctcgttcagaatgacccagattgtttctgctttgggtgcagctgtttagttcagagttatattacagagaattattttctgagataatcttaaactagaatgttcaaaactaattgataattgaagtatcaagatacgtagaacacctcagagatttttcttcaggaacttccacaaactttgaatccttgtatctttatttggtattcatactactagtagcaaaatacaggttttttgttttgttttgttttgttttggcttcatagagtatctcaaattgaaacttttctgcacaaagaataaaattaaggattttataaactcaaattggcacctactgaattaaaatacataaaatcatttaaatataattcagcatatgggaagtaacattgcactaatatggaaatcactgccagagacagtctattttcttttaatttgttactacttagtcacaaaccccacattattccagtttggaattacttattaaggagaattggaaatacatatgcccatgcttaaattttatagctttaatttgtgttatttctttattgacgggaagaggtacatctttttttccttactgaaaacaaatatggattaattgcctcaaatttgtataagtgattggctagtgattcttgttttcagaagggagagtggtatagatagaaaatgacaaagatggcaatatacacttaatgttgttattgtatgttgttactgaagtacttagatttttaaaatttcaaatcctaaatcacttcttgtaggagggttttcattaactgcagtatatacagttcactacatatgggttgtttgagttttttgtgtgctgtatttctttctgttttttaatacctggttttgtacatatctaactctgttctcttttggttgttcagaaactggattttttttttcttaagcagtgcttaatttgtgttttttaattttgattcagaagtagtcccagctcataggtgttcatactgttacatccagaacatttgtcaggctctctgtcagctttcatgtacatatggtatagaaaccatggagttaggcacttcctggattttttttttatgagaaaaatactgtatttaaaatgtaaaataaacttttaaaaagcaggcactaatatatatttcttccagcctttgattacaaatttgtccttgcacatgttaagatgaattatctcctaaaaatatcattgttcttgggagcagtgtatgttactttacatagcagcggttcctgtcatgtgttcatgtcagaatatttttggttttaaactttcttattgcctttggctgttgattagtacagtacaagtgcgatttcaaaaagatcttgaaagtaatatatttaatcaattaaaatgtttatctgtaaaaaaaaaaaaaaaaaa

SEQ ID NO: 236 - protein, 528 aa, Homo sapiens
MAAVLNAERLEVSVDGLTLSPDPEERPGAEGAPLLPPPLPPPSPPGSGRGPGASGEQPEPGEAAAGGAAEEARRLEQRWGFGLEELYGLALRFFKEKDGKAFHPTYEEKLKLVALHKQVLMGPYNPDTCPEVGFFDVLGNDRRREWAALGNMSKEDAMVEFVKLLNRCCHLFSTYVASHKIEKEEQEKKRKEEEERRRREEEERERLQKEEEKRRREEEERLRREEEERRRIEEERLRLEQQKQQIMAALNSQTAVQFQQYAAQQYPGNYEQQQILIRQLQEQHYQQYMQQLYQVQLAQQQAALQKQQEVVVAGSSLPTSSKVNATVPSNMMSVNGQAKTHTDSSEKELEPEAAEEALENGPKESLPVIAAPSMWTRPQIKDFKEKIQQDADSVITVGRGEVVTVRVPTHEEGSYLFWEFATDNYDIGFGVYFEWTDSPNTAVSVHVSESSDDDEEEEENIGCEEKAKKNANKPLLDEIVPVYRRDCHEEVYAGSHQYPGRGVYLLKFDNSYSLWRSKSVYYRVYYTR

SEQ ID NO: 237 - DNA, 1298 bp, Homo sapiens
gagccagttccaaaatggcggcaggggtggccgggtggggggttgaggcagaggagttcgaagatgctcctgatgtggagccgctggagcctacacttagcaacatcatcgagcagcgcagcctgaagtggatcttcgtcgggggcaagggtggtgtgggcaagaccacctgcagctgcagcctggcagtccagctctccaaggggcgtgagagtgttctgatcatctccacagacccagcacacaacatctcagatgcttttgaccagaagttctcaaaggtgcctaccaaggtcaaaggctatgacaacctctttgctatggagattgaccccagcctgggcgtggcggagctgcctgacgagttcttcgaggaggacaacatgctgagcatgggcaagaagatgatgcaggaggccatgagcgcatttcccggcatcgatgaggccatgagctatgccgaggtcatgaggctggtgaagggcatgaacttctcggtggtggtatttgacacggcacccacgggccacaccctgaggctgctcaacttccccaccatcgtggagcggggcctgggccggcttatgcagatcaagaaccagatcagccctttcatctcacagatgtgcaacatgctgggcctgggggacatgaacgcagaccagctggcctccaagctggaggagacgctgcccgtcatccgctcagtcagcgaacagttcaaggaccctgagcagacaactttcatctgcgtatgcattgctgagttcctgtccctgtatgagacagagaggctgatccaggagctggccaagtgcaagattgacacacacaatataattgtcaaccagctcgtcttccccgaccccgagaagccctgcaagatgtgtgaggcccgtcacaagatccaggccaagtatctggaccagatggaggacctgtatgaagacttccacatcgtgaagctgccgctgttaccccatgaggtgcggggggcagacaaggtcaacaccttctcggccctcctcctggagccctacaagccccccagtgcccagtagcacagctgccagccccaaccgctgccatttcacactcaccctccaccctccccaccccctcggggcagagtttgcacaaagtcccccccataatacagggggagccacttgggcaggaggcagggaggggtccattccccctggtggggctggtggggagctgtagttgccccctacctctcccacctcttgctcttcaataaaatgatcttaaactgcaaaaaaaaaaaaaaaaaa

SEQ ID NO: 238 - protein, 348 aa, Homo sapiens
MAAGVAGWGVEAEEFEDAPDVEPLEPTLSNIIEQRSLKWIFVGGKGGVGKTTCSCSLAVQLSKGRESVLIISTDPAHNISDAFDQKFSKVPTKVKGYDNLFAMEIDPSLGVAELPDEFFEEDNMLSMGKKMMQEAMSAFPGIDEAMSYAEVMRLVKGMNFSVVVFDTAPTGHTLRLLNFPTIVERGLGRLMQIKNQISPFISQMCNMLGLGDMNADQLASKLEETLPVIRSVSEQFKDPEQTTFICVCIAEFLSLYETERLIQELAKCKIDTHNIIVNQLVFPDPEKPCKMCEARHKIQAKYLDQMEDLYEDFHIVKLPLLPHEVRGADKVNTFSALLLEPYKPPSAQ

SEQ ID NO: 239 - DNA, 2187 bp, Homo sapiens
gttgactcggccatcggcctgccgggcctggcgtttcccagaaggcccagcgccgggaaggggtttgcagctgctccgtcatcgtgcggcccgacgctatctcgcgctcgtgtgcaggcccggctcggctcctggtccccggtgcgagggttaacgcgaggccccggcctcggtccccggactaggccgtgaccccgggtgccatgaagcaggagggctcggcgcggcgccgcggcgcggacaaggcgaaaccgccgcccggcggaggagaacaagaacccccaccgccgccggccccccaggatgtggagatgaaagaggaggcagcgacgggtggcgggtcgacgggggaggcagacggcaagacggcggcggcagcggctgagcactcccagcgagagctggacacagtcaccttggaggacatcaaggagcacgtgaaacagctagagaaagcggtttcaggcaaggagccgagattcgtgctgcgggccctgcggatgctgccttccacatcacgccgcctcaaccactatgttctgtataaggctgtgcagggcttcttcacttcaaataatgccactcgagactttttgctccccttcctggaagagcccatggacacagaggctgatttacagttccgtccccgcacgggaaaagctgcgtcgacacccctcctgcctgaagtggaagcctatctccaactcctcgtggtcatcttcatgatgaacagcaagcgctacaaagaggcacagaagatctctgatgatctgatgcagaagatcagtactcagaaccgccgggccctagaccttgtagccgcaaagtgttactattatcacgcccgggtctatgagttcctggacaagctggatgtggtgcgcagcttcttgcatgctcggctccggacagctacgcttcggcatgacgcagacgggcaggccaccctgttgaacctcctgctgcggaattacctacactacagcttgtacgaccaggctgagaagctggtgtccaagtctgtgttcccagagcaggccaacaacaatgagtgggccaggtacctctactacacagggcgaatcaaagccatccagctggagtactcagaggcccggagaacgatgaccaacgcccttcgcaaggcccctcagcacacagctgtcggcttcaaacagacggtgcacaagcttctcatcgtggtggagctgttgctgggggagatccctgaccggctgcagttccgccagccctccctcaagcgctcactcatgccctatttccttctgactcaagctgtcaggacaggaaacctagccaagttcaaccaggtcctggatcagtttggggagaagtttcaagcagatgggacctacaccctaattatccggctgcggcacaacgtgattaagacaggtgtacgcatgatcagcctctcctattcccgaatctccttggctgacatcgcccagaagctgcagttggatagccccgaagatgcagagttcattgttgccaaggccatccgggatggtgtcattgaggccagcatcaaccacgagaagggctatgtccaatccaaggagatgattgacatctattccacccgagagccccagctagccttccaccagcgcatctccttctgcctagatatccacaacatgtctgtcaaggccatgaggtttcctcccaaatcgtacaacaaggacttggagtctgcagaggaacggcgtgagcgagaacagcaggacttggagtttgccaaggagatggcagaagatgatgatgacagcttcccttgagctggggggctggggaggggtagggggaatggggacaggctctttcccccttgggggtcccctgcccagggcactgtccccattttcccacacacagctcatatgctgcattcgtgcagggggtgggggtgctgggagccagccaccctgacctcccccagggctcctccccagccggtgacttactgtacagcaggcaggagggtgggcaggcaacctccccgggcagggtcctggccagcagtgtgggagcaggaggggaaggatagttctgtgtactcctttagggagtgggggactagaactgggatgtcttggcttgtatgttttttgaagcttcgattatgatttttaaacaataaaaagttctccacagtgc

SEQ ID NO: 240 - protein, 534 aa, Homo sapiens
MKQEGSARRRGADKAKPPPGGGEQEPPPPPAPQDVEMKEEAATGGGSTGEADGKTAAAAAEHSQRELDTVTLEDIKEHVKQLEKAVSGKEPRFVLRALRMLPSTSRRLNHYVLYKAVQGFFTSNNATRDFLLPFLEEPMDTEADLQFRPRTGKAASTPLLPEVEAYLQLLVVIFMMNSKRYKEAQKISDDLMQKISTQNRRALDLVAAKCYYYHARVYEFLDKLDVVRSFLHARLRTATLRHDADGQATLLNLLLRNYLHYSLYDQAEKLVSKSVFPEQANNNEWARYLYYTGRIKAIQLEYSEARRTMTNALRKAPQHTAVGFKQTVHKLLIVVELLLGEIPDRLQFRQPSLKRSLMPYFLLTQAVRTGNLAKFNQVLDQFGEKFQADGTYTLIIRLRHNVIKTGVRMISLSYSRISLADIAQKLQLDSPEDAEFIVAKAIRDGVIEASINHEKGYVQSKEMIDIYSTREPQLAFHQRISFCLDIHNMSVKAMRFPPKSYNKDLESAEERREREQQDLEFAKEMAEDDDDSFP

SEQ ID NO: 241 - DNA, 2339 bp, Homo sapiens
cctgtggtcccgggtttctgcagagtctacttcagaagcggaggcactgggagtccggtttgggattgccaggctgtggttgtgagtctgagcttgtgagcggctgtggcgccccaactcttcgccagcatatcatcccggcaggcgataaactacattcagttgagtctgcaagactgggaggaactggggtgataagaaatctattcactgtcaaggtttattgaagtcaaaatgtccaaaaaaatcagtggcggttctgtggtagagatgcaaggagatgaaatgacacgaatcatttgggaattgattaaagagaaactcatttttccctacgtggaattggatctacatagctatgatttaggcatagagaatcgtgatgccaccaacgaccaagtcaccaaggatgctgcagaagctataaagaagcataatgttggcgtcaaatgtgccactatcactcctgatgagaagagggttgaggagttcaagttgaaacaaatgtggaaatcaccaaatggcaccatacgaaatattctgggtggcacggtcttcagagaagccattatctgcaaaaatatcccccggcttgtgagtggatgggtaaaacctatcatcataggtcgtcatgcttatggggatcaatacagagcaactgattttgttgttcctgggcctggaaaagtagagataacctacacaccaagtgacggaacccaaaaggtgacatacctggtacataactttgaagaaggtggtggtgttgccatggggatgtataatcaagataagtcaattgaagattttgcacacagttccttccaaatggctctgtctaagggttggcctttgtatctgagcaccaaaaacactattctgaagaaatatgatgggcgttttaaagacatctttcaggagatatatgacaagcagtacaagtcccagtttgaagctcaaaagatctggtatgagcataggctcatcgacgacatggtggcccaagctatgaaatcagagggaggcttcatctgggcctgtaaaaactatgatggtgacgtgcagtcggactctgtggcccaagggtatggctctctcggcatgatgaccagcgtgctggtttgtccagatggcaagacagtagaagcagaggctgcccacgggactgtaacccgtcactaccgcatgtaccagaaaggacaggagacgtccaccaatcccattgcttccatttttgcctggaccagagggttagcccacagagcaaagcttgataacaataaagagcttgccttctttgcaaatgctttggaagaagtctctattgagacaattgaggctggcttcatgaccaaggacttggctgcttgcattaaaggtttacccaatgtgcaacgttctgactacttgaatacatttgagttcatggataaacttggagaaaacttgaagatcaaactagctcaggccaaactttaagttcatacctgagctaagaaggataattgtcttttggtaactaggtctacaggtttacatttttctgtgttacactcaaggataaaggcaaaatcaattttgtaatttgtttagaagccagagtttatcttttctataagtttacagcctttttcttatatatacagttattgccacctttgtgaacatggcaagggacttttttacaatttttattttattttctagtaccagcctaggaattcggttagtactcatttgtattcactgtcactttttctcatgttctaattataaatgaccaaaatcaagattgctcaaaagggtaaatgatagccacagtattgctccctaaaatatgcataaagtagaaattcactgccttcccctcctgtccatgaccttgggcacagggaagttctggtgtcatagatatcccgttttgtgaggtagagctgtgcattaaacttgcacatgactggaacgaagtatgagtgcaactcaaatgtgttgaagatactgcagtcatttttgtaaagaccttgctgaatgtttccaatagactaaatactgtttaggccgcaggagagtttggaatccggaataaatactacctggaggtttgtcctctccatttttctctttctcctcctggcctggcctgaatattatactactctaaatagcatatttcatccaagtgcaataatgtaagctgaatcttttttggacttctgctggcctgttttatttcttttatataaatgtgatttctcagaaattgatattaaacactatcttatcttctcctgaactgttgattttaattaaaattaagtgctaattaccaaaaaaaaaaa

SEQ ID NO: 242 - protein, 414 aa, Homo sapiens
MSKKISGGSVVEMQGDEMTRIIWELIKEKLIFPYVELDLHSYDLGIENRDATNDQVTKDAAEAIKKHNVGVKCATITPDEKRVEEFKLKQMWKSPNGTIRNILGGTVFREAIICKNIPRLVSGWVKPIIIGRHAYGDQYRATDFVVPGPGKVEITYTPSDGTQKVTYLVHNFEEGGGVAMGMYNQDKSIEDFAHSSFQMALSKGWPLYLSTKNTILKKYDGRFKDIFQEIYDKQYKSQFEAQKIWYEHRLIDDMVAQAMKSEGGFIWACKNYDGDVQSDSVAQGYGSLGMMTSVLVCPDGKTVEAEAAHGTVTRHYRMYQKGQETSTNPIASIFAWTRGLAHRAKLDNNKELAFFANALEEVSIETIEAGFMTKDLAACIKGLPNVQRSDYLNTFEFMDKLGENLKIKLAQAKL

SEQ ID NO: 243 - DNA, 4205 bp, Homo sapiens
ctccctcgctccctccctgcgcgccgcctctcactcacagcctcccttccttctttctccctccgcctcccgagcaccagcgcgctctgagctgcccccagggtccctcccccgccgccagcagcccatttggagggaggaagtaagggaagaggagaggaaggggagccggaccgactacccagacagagccggtgaatgggtttgtggtgacccccgccccccaccccaccctcccttcccacccgacccccaacccccatccccagttcgagccgccgcccgaaaggccgggccgtcgtcttaggaggagtcgccgccgccgccacctccgccatggagctgatcaccattctcgagaagaccgtgtctcccgatcggctggagctggaagcggcgcagaagttcctggagcgtgcggccgtggagaacctgcccactttccttgtggaactgtccagagtgctggcaaatccaggaaacagtcaggttgccagagttgcagctggtctacaaatcaagaactctttgacatctaaagatccagatatcaaggcacaatatcagcagaggtggcttgctattgatgctaatgctcgacgagaagtcaagaactatgttttgcagacattgggtacagaaacttaccggcctagttctgcctcacagtgtgtggctggtattgcttgtgcagagatcccagtaaaccagtggccagaactcattcctcagctggtggccaatgtcacaaaccccaacagcacagagcacatgaaggagtcgacattggaagccatcggttatatttgccaagatatagacccagagcagctacaagataaatccaatgagattctgactgccataatccaggggatgaggaaagaagagcctagtaataatgtgaagctagctgctacgaatgcactcctgaactcattggagttcaccaaagcaaactttgataaagagtctgaaaggcactttattatgcaggtggtctgtgaagccacacagtgtccagatacgagggtacgagtggctgctttacagaatctggtgaagataatgtccttatattatcagtacatggagacatatatgggtcctgctctttttgcaatcacaatcgaagcaatgaaaagtgacattgatgaggtggctttacaagggatagaattctggtccaatgtctgtgatgaggaaatggatttggccattgaagcttcagaggcagcagaacaaggacggccccctgagcacaccagcaagttttatgcgaagggagcactacagtatctggttccaatcctcacacagacactaactaaacaggacgaaaatgatgatgacgatgactggaacccctgcaaagcagcaggggtgtgcctcatgcttctggccacctgctgtgaagatgacattgtcccacatgtcctccccttcattaaagaacacatcaagaacccagattggcggtaccgggatgcagcagtgatggcttttggttgtatcttggaaggaccagagcccagtcagctcaaaccactagttatacaggctatgcccaccctaatagaattaatgaaagaccccagtgtagttgttcgagatacagctgcatggactgtaggcagaatttgtgagctgcttcctgaagctgccatcaatgatgtctacttggctcccctgctacagtgtctgattgagggtctcagtgctgaacccagagtggcttcaaatgtgtgctgggctttctccagtctggctgaagctgcttatgaagctgcagacgttgctgatgatcaggaagaaccagctacttactgcttatcttcttcatttgaactcatagttcagaagctcctagagactacagacagacctgatggacaccagaacaacctgaggagttctgcatatgaatctctgatggaaattgtgaaaaacagtgccaaggattgttatcctgctgtccagaaaacgactttggtcatcatggaacgactgcaacaggttcttcagatggagtcacatatccagagcacatccgatagaatccagttcaatgaccttcagtctttactctgtgcaactcttcagaatgttcttcggaaagtgcaacatcaagatgctttgcagatctctgatgtggttatggcctccctgttaaggatgttccaaagcacagctgggtctgggggagtacaagaggatgccctgatggcagttagcacactggtggaagtgttgggtggtgaattcctcaagtacatggaggcctttaaacccttcctgggcattggattaaaaaattatgctgaataccaggtttgtttggcagctgtgggcttagtgggagacttgtgccgtgccctgcaatccaacatcatacctttctgtgacgaggtgatgcagctgcttctggaaaatttggggaatgagaacgtccacaggtctgtgaagccgcagattctgtcagtgtttggtgatattgcccttgctattggaggagagtttaaaaaatacttagaggttgtattgaatactcttcagcaggcctcccaagcccaggtggacaagtcagactatgacatggtggattatctgaatgagctaagggaaagctgcttggaagcctatactggaatcgtccagggattaaagggggatcaggagaacgtacacccggatgtgatgctggtacaacccagagtagaatttattctgtctttcattgaccacattgctggagatgaggatcacacagatggagtagtagcttgtgctgctggactaataggggacttatgtacagcatttgggaaggatgtactgaaattagtagaagctaggccaatgatccatgaattgttaactgaagggcggagatcgaagactaacaaagcaaaaacccttgctacatgggcaacaaaagaactgaggaaactgaagaaccaagcttgatctgttaccattgggatgataacctgaggacccccactggaaatctcccatcttttgaaaaacctggaagtgaggagtgtgcacggatgctgaatgtttgggaatgagaggatgagtgagtgaggcttgaaaacacaccacattgaaaatcctgccacagcagcagccgcagccgccaacagcagcgctgttagtgagctaagtaagcactgacttcgtagaaaaccataacatcggccatcttggaaaagagaaaaacaatggagttacttatttaaaaaaaaagaaagaaagttatctcttcccaggagaggctagaagtagcttttctgtcttttggccagtgccgagtggaatgcctggtttgggggaggaggagggactgggttcagctgtggtgctttgttgtaaaaggcagcctggcctttgctactgaggagaaagatggagcctgggtctcaagcccaccttcgctgtacctttgccacatggtactgtatgcttgccagctagaaggagggtcagggattttttacagtctgagaatgagtgtgtgtgagtgaggcggtatccacattctcaacttcaagtcattgcagtttctttttcccagaaaacaaggggttagatgttgcatttcataaaactaaccgaagttctgtctactgatgcagcacaagagatgtaaaaaaaaaaaaaaaaaaaaaaaaaaaaacacacacacagaggaaagacgctctttaggttttgttttgttttttttttttggttttgttttttgttttttttactctagggaaaacactgacgaatggtcagagctcctatcctgatcttttcatcaaggcgcctttcctaataatatggttcaactgtgaatgtagaagtgggggggaggggggagaaaaagaaaactctggcgttagaggatatagaaaaatataagtacaattgttacaaataacgcagacttcaaaaacaaaaaaatcacaacccaaacaaaccaaaatttaaatgatcagaattggcagcacaaagaaaacgccctctcctgacttgtattgtggcagtctgaacgcccccagaaaattgtgccaaagagtttagaaaaataaatatacaataaaagtaaacacatacacacaaaacagcaaacttcaggtaactattttggattgcaaacaggataaattaaatgttcaaacaatctgataaaataaccatttggaaactgaaaa

SEQ ID NO: 244 - protein, 876 aa, Homo sapiens
MELITILEKTVSPDRLELEAAQKFLERAAVENLPTFLVELSRVLANPGNSQVARVAAGLQIKNSLTSKDPDIKAQYQQRWLAIDANARREVKNYVLQTLGTETYRPSSASQCVAGIACAEIPVNQWPELIPQLVANVTNPNSTEHMKESTLEAIGYICQDIDPEQLQDKSNEILTAIIQGMRKEEPSNNVKLAATNALLNSLEFTKANFDKESERHFIMQVVCEATQCPDTRVRVAALQNLVKIMSLYYQYMETYMGPALFAITIEAMKSDIDEVALQGIEFWSNVCDEEMDLAIEASEAAEQGRPPEHTSKFYAKGALQYLVPILTQTLTKQDENDDDDDWNPCKAAGVCLMLLATCCEDDIVPHVLPFIKEHIKNPDWRYRDAAVMAFGCILEGPEPSQLKPLVIQAMPTLIELMKDPSVVVRDTAAWTVGRICELLPEAAINDVYLAPLLQCLIEGLSAEPRVASNVCWAFSSLAEAAYEAADVADDQEEPATYCLSSSFELIVQKLLETTDRPDGHQNNLRSSAYESLMEIVKNSAKDCYPAVQKTTLVIMERLQQVLQMESHIQSTSDRIQFNDLQSLLCATLQNVLRKVQHQDALQISDVVMASLLRMFQSTAGSGGVQEDALMAVSTLVEVLGGEFLKYMEAFKPFLGIGLKNYAEYQVCLAAVGLVGDLCRALQSNIIPFCDEVMQLLLENLGNENVHRSVKPQILSVFGDIALAIGGEFKKYLEVVLNTLQQASQAQVDKSDYDMVDYLNELRESCLEAYTGIVQGLKGDQENVHPDVMLVQPRVEFILSFIDHIAGDEDHTDGVVACAAGLIGDLCTAFGKDVLKLVEARPMIHELLTEGRRSKTNKAKTLATWATKELRKLKNQA

SEQ ID NO: 245 - DNA, 4805 bp, Homo sapiens
gttaagttggagccgactcagcggcggccgccattttgtgcagtcgctgggaaggaaggagacgcctaaaccgcggcactgcccggtttgagcgtagccaaacctgcccaccggctttgtagccccgattctctgtgttttgctcccgtctccgacgagagaggcggcgacggtggcgtctgcgacgggagacagcgcgtcggagcgagagagcgctgcgcctgccgccgccccaacagcggaggcgccgccgccatcggtcgtcaccagaccggagccgcaggccctcccgagcccggccatccgtgccccgctcccagatctctatccttttgggaccatgcgcggaggaggctttggggaccgggaccgggatcgtgaccgtggaggatttggagcaagaggtggtggtggccttcccccgaagaaatttggtaatcctggggagcgtttgcgtaaaaaaaagtgggatttgagtgagctccccaagtttgagaaaaatttttatgtggaacatccggaagtagcaaggctgacaccatatgaggttgatgagctacgccgaaagaaggagattacagtgagggggggagatgtttgtcctaaacccgtgtttgccttccatcatgctaacttcccacaatatgtaatggatgtgttgatggatcagcactttacagaaccaactccaattcagtgccagggatttccgttggctcttagtggccgggatatggtgggcattgctcagactggctctgggaagacgttggcgtatctcctgcctgcaattgttcatattaaccaccagccatacttggaaaggggagatggcccaatctgtctagttctggctcctaccagagagcttgcccagcaagtacagcaggtggccgatgactatggcaaatgttctagattgaagagtacttgtatttatggaggtgctcctaaaggtccccagattcgagacttggaaagaggtgttgagatctgcatagccactcctggacgtctgatagatttcctggagtcaggaaagacaaatcttcgccgatgtacttaccttgtattggacgaagctgacagaatgcttgatatggggtttgaaccccagatccgtaaaattgttgaccaaatcaggcctgataggcagacactgatgtggagtgcaacctggccaaaagaagtaagacagcttgcagaggatttccttcgtgattacacccagatcaacgtaggcaatctggagttgagtgccaaccacaacatcctccagatagtggatgtctgcatggaaagtgaaaaagaccacaagttgatccaactaatggaagaaataatggctgaaaaggaaaacaaaacaataatatttgtggagacaaagagacgctgtgatgatctgactcgaaggatgcgcagagatggttggccagctatgtgtatccatggagacaagagtcaaccagaaagagattgggtacttaatgagttccgttctggaaaggcacccatccttattgctacagatgtagcctcccgtgggctagatgtggaagatgtcaagtttgtgatcaactatgactatccaaacagctcagaggattatgtgcaccgtattggccgaacagcccgtagcaccaacaagggtaccgcctataccttcttcaccccagggaacctaaaacaggccagagagcttatcaaagtgctggaagaggccaatcaggctatcaatccaaaactgatgcagcttgtggaccacagaggaggcggcggaggcgggggtggtcgttctcgttaccggaccacttcttcagccaacaatcccaatctgatgtatcaggatgagtgtgaccgaaggcttcgaggagtcaaggatggtggccggagagactctgcaagctatcgggatcgtagtgaaaccgatagagctggttatgctaatggcagtggctatggaagtccaaattctgcctttggagcacaagcaggccaatacacctatggtcaaggcacctatggggcagctgcttatggcaccagtagctatacagctcaagaatatggtgctggcacttatggagctagtagcaccacctcaactgggagaagttcacagagctctagccagcagtttagtgggataggccggtctgggcagcagccacagccactgatgtcacaacagtttgcacagcctccgggagctaccaatatgataggttacatggggcagactgcctaccaataccctcctcctcctccccctcctcctccttcacgtaaatgaaaccactcaagtggtagtgactccagcagacttaattacattttaaggaacactgtctttcctttttttttcctcttcgccttttctttttttttccttttttctttttttttttttaatttttccccccaaccatcgtgatttgtcttttcatgcagattagttagaattcactgccaggtttcttctgcccaccaaaatgatccagtctggaataacattttgtaaaaaaaaaaaaaatatatatatatatatatagctgactggaagagattaatttcttcccccaacttcttgcatgttgaagatatttgagctatttttcatctaaaagagtaaggtattaggcccttttgtgggagccccatgttttgtttttctgagttggtggggagggagggagggggagggctgaattgttttgcagaggaagatggcatctgtgctttaaatttctcattactgggttagaaaacaaagagggattgccctgcacattttcttttgtgcttttaaatgtttcttaagttggaacaggtttcctcgggcctgttttgactgattgctggagtgcatttgatagttaaaaattactaattggttttatttcccttcacactctgcctccccacttctccccccgttactgaaaaataaccattttagtgtcaggctagaaattgaattgctgagttttgtgtatcctttaaattaaaaaccacaagtgtttattgtagtggttaaactgtagcatctcagcatctgggtggaagctgcctatatttcttcccagtttaactggggaccatctgtgaaattaattttccatccagacagctgctgtgagcaaatgaacataaatgctcgctggaaatttactaaccagtttttatattgacctgcagtgtaaaaagcacatttaattataaacaatatattcaaaatgggcaaattttattttcaaatgcagtgtagagctagattaaaagcaactctttgccacctactctgcccttttggcaaagttaccttgaacaaagaatcttaagggtttattaagaactctttattttcttcataccctgttctctgcagtgctttctaacagcttctgggtgcagattttcttcggcatccttttgcactcagcttattacaggtaggtagtgcttaagaaaagtcatggaggactaaagcctaagtccttttcacttttcctccatctgaaggtaggtgagttcatcctcttcatggtaatgctgttttaccaagactttatagcagatggacccagaaagaattttctgctattgtgttcactacaacaggatagggacatcagacagccccagaaaccccttccagatctgatatgggactattaatttttatgctgttaattggtattcattcacaatgcagttgaagggggaaggctccactgcattctttggctaaggcctgaatgcttgctcatctgtaagatctatactcgaggttttgttttccttttaaaattctttagggagagagggatggtttctgaggggttctgaaagtatgattcaatgtgcaacatacaggtaggtcttcagcataagctgaaatatatgcatgtaaaaactttgacatctttttttttaattttccactttcttcttaactttacttctctttttgtcccccccccatcttacagaagttgaggccaagggagaatggtaggcacagaagaaacatggcaaactgctctgtgctttcaaaccaaagtgttccccccaaccccaaatttgtctaagcactggccagtctgttgtgggcattgttttctacaaccaaattctgggtttttttcttctttctttaaacatagaggtaccaccacaagggatgccctactctctcgcagctcttgaaagcatctgtttgagggaaaggtctctgggcaagcaagtggttatttggattgcttgcttccctttttccacctgggacattgtaatcataaaataacagtaaattccaaacctcaaaaactattatggcctgagcacagctgaaatctagcagagtttaactcttctgcctccatgtctgtcacttataattcaggttctgctgttggcttcagaacatgagcagaagaatcgttttatgctagttattgcattcatggttgaaactcaacttagggaaagggttccaatgtattaagcaatgggctgcttctccccaatcctccctaacaattcgttgtgtggacttctcatctaaaaggttagtggcttttgcttgggatcagtgctctctattgatgttcttgctggtctccagacacattcctgttgcattaagacttgaaagacttgtagatgtgtgatgttcaggcacaggatgctgaaagctatgttactattcttagtttgtaaattgtccttttgataccatcatcttgttttctttttgtaggtataaataaaaacactgttgacaataaaaaaaaaaaaaaaaa

SEQ ID NO: 246 - protein, 729 aa, Homo sapiens
MPTGFVAPILCVLLPSPTREAATVASATGDSASERESAAPAAAPTAEAPPPSVVTRPEPQALPSPAIRAPLPDLYPFGTMRGGGFGDRDRDRDRGGFGARGGGGLPPKKFGNPGERLRKKKWDLSELPKFEKNFYVEHPEVARLTPYEVDELRRKKEITVRGGDVCPKPVFAFHHANFPQYVMDVLMDQHFTEPTPIQCQGFPLALSGRDMVGIAQTGSGKTLAYLLPAIVHINHQPYLERGDGPICLVLAPTRELAQQVQQVADDYGKCSRLKSTCIYGGAPKGPQIRDLERGVEICIATPGRLIDFLESGKTNLRRCTYLVLDEADRMLDMGFEPQIRKIVDQIRPDRQTLMWSATWPKEVRQLAEDFLRDYTQINVGNLELSANHNILQIVDVCMESEKDHKLIQLMEEIMAEKENKTIIFVETKRRCDDLTRRMRRDGWPAMCIHGDKSQPERDWVLNEFRSGKAPILIATDVASRGLDVEDVKFVINYDYPNSSEDYVHRIGRTARSTNKGTAYTFFTPGNLKQARELIKVLEEANQAINPKLMQLVDHRGGGGGGGGRSRYRTTSSANNPNLMYQDECDRRLRGVKDGGRRDSASYRDRSETDRAGYANGSGYGSPNSAFGAQAGQYTYGQGTYGAAAYGTSSYTAQEYGAGTYGASSTTSTGRSSQSSSQQFSGIGRSGQQPQPLMSQQFAQPPGATNMIGYMGQTAYQYPPPPPPPPPSRK

SEQ ID NO: 247 - DNA, 2345 bp, Homo sapiens
tggcgcgggcaatccctcaacctgattggtcccctcgcccgtcactccagtgcgcccccaacctaccacgcagtaaaagccacccccgcctcggcccggacggtttccaagctggttttgaagtcgcggcagctgttcctgggacgtccggttgaccgcgcgtctgctgcagagaccatgtctgccgacggggcagaggctgatggcagcacccaggtgacagtggaagaaccggtacagcagcccagtgtggtggaccgtgtggccagcatgcctctgatcagctccacctgcgacatggtgtccgcagcctatgcctccaccaaggagagctacccgcacatcaagactgtctgcgacgcagcagagaagggagtgaggaccctcacggcggctgctgtcagcggggctcagccgatcctctccaagctggagccccagattgcatcagccagcgaatacgcccacagggggctggacaagttggaggagaacctccccatcctgcagcagcccacggagaaggtcctggcggacaccaaggagcttgtgtcgtctaaggtgtcgggggcccaagagatggtgtctagcgccaaggacacggtggccacccaattgtcggaggcggtggacgcgacccgcggtgctgtgcagagcggcgtggacaagacaaagtccgtagtgaccggcggcgtccaatcggtcatgggctcccgcttgggccagatggtgttgagtggggtcgacacggtgctggggaagtcggaggagtgggcggacaaccacctgccccttacggatgccgaactggcccgcatcgccacatccctggatggctttgacgtcgcgtccgtgcagcagcagcggcaggaacagagctacttcgtacgtctgggctccctgtcggagaggctgcggcagcacgcctatgagcactcgctgggcaagcttcgagccaccaagcagagggcacaggaggctctgctgcagctgtcgcaggtcctaagcctgatggaaactgtcaagcaaggcgttgatcagaagctggtggaaggccaggagaagctgcaccagatgtggctcagctggaaccagaagcagctccagggccccgagaaggagccgcccaagccagagcaggtcgagtcccgggcgctcaccatgttccgggacattgcccagcaactgcaggccacctgtacctccctggggtccagcattcagggcctccccaccaatgtgaaggaccaggtgcagcaggcccgccgccaggtggaggacctccaggccacgttttccagcatccactccttccaggacctgtccagcagcattctggcccagagccgtgagcgtgtcgccagcgcccgcgaggccctggaccacatggtggaatatgtggcccagaacacacctgtcacgtggctcgtgggaccctttgcccctggaatcactgagaaagccccggaggagaagaagtagggggagaggagaggactcagcgggccccgtctctataatgcagctgtgctctggagtcctcaacccggggctcatttcaaacttattttctagccactcctcccagctcttctgtgctgtccacttgggaagctaaggctctcaaaacgggcatcacccagttgacccatctctcagcctctctgagcttggaagaagcctgttctgagcctcaccctatcagtcagtagagagagatgtccagaaaaaatatctttcaggaaagttctcccctgcagaattttttttccttgttaaatatcaggaatataggccgggtgcggtggctcacacctgtaatcccagcactttgggaggctgaggcgggcggaacacctgaggtcaggtgttcgagaccagccaggccaacatggtgaaaccccgtctctactaaaaatacaaaaaaaaatgagccgggcatggtagcaggtgtctgttatcccagttaggaggctgaggcaagagaatctcttgaacctgagaggcggaggttgcagtgagccaagatcgcgccattgcactccagcctgggggacaagagtgagacttagtctcaaaaaaaaaaaaaaagaaaaaaaaatcagggatatagttcatatcccacttctttgtttacaccgatgtccctgaatatcagcctgtagctaatggacttgggatttctggtctaagtgggcctcctggggatggggtggtacactgagcttctgagcctcattgtagagtagaaaggtactggggcctgtgtggtaagccttgttgaaatgctctggtattcagtattgccttaataaacttcacccacaactgcatacaggcaaaaa

SEQ ID NO: 248 - protein, 434 aa, Homo sapiens
MSADGAEADGSTQVTVEEPVQQPSVVDRVASMPLISSTCDMVSAAYASTKESYPHIKTVCDAAEKGVRTLTAAAVSGAQPILSKLEPQIASASEYAHRGLDKLEENLPILQQPTEKVLADTKELVSSKVSGAQEMVSSAKDTVATQLSEAVDATRGAVQSGVDKTKSVVTGGVQSVMGSRLGQMVLSGVDTVLGKSEEWADNHLPLTDAELARIATSLDGFDVASVQQQRQEQSYFVRLGSLSERLRQHAYEHSLGKLRATKQRAQEALLQLSQVLSLMETVKQGVDQKLVEGQEKLHQMWLSWNQKQLQGPEKEPPKPEQVESRALTMFRDIAQQLQATCTSLGSSIQGLPTNVKDQVQQARRQVEDLQATFSSIHSFQDLSSSILAQSRERVASAREALDHMVEYVAQNTPVTWLVGPFAPGITEKAPEEKK

SEQ ID NO: 249 - DNA, 1734 bp, Homo sapiens; identical to SEQ ID NO: 143

SEQ ID NO: 250 - protein, 411 aa, Homo sapiens; identical to SEQ ID NO: 144

SEQ ID NO: 251 - DNA, 7219 bp, Homo sapiens
ggaccccggcaagcccgcgcacttggcaggagctgtagctaccgccgtccgcgcctccaaggtttcacggcttcctcagcagagactcgggctcgtccgccatgtccgccgcagacgaggttgacgggctgggcgtggcccggccgcactatggctctgtcctggataatgaaagacttactgcagaggagatggatgaaaggagacgtcagaacgtggcttatgagtacctttgtcatttggaagaagcgaagaggtggatggaagcatgcctaggggaagatctgcctcccaccacagaactggaggaggggcttaggaatggggtctaccttgccaaactggggaacttcttctctcccaaagtagtgtccctgaaaaaaatctatgatcgagaacagaccagatacaaggcgactggcctccactttagacacactgataatgtgattcagtggttgaatgccatggatgagattggattgcctaagattttttacccagaaactacagatatctatgatcgaaagaacatgccaagatgtatctactgtatccatgcactcagtttgtacctgttcaagctaggcctggcccctcagattcaagacctatatggaaaggttgacttcacagaagaagaaatcaacaacatgaagactgagttggagaagtatggcatccagatgcctgcctttagcaagattgggggcatcttggctaatgaactgtcagtggatgaagccgcattacatgctgctgttattgctattaatgaagctattgaccgtagaattccagccgacacatttgcagctttgaaaaatccgaatgccatgcttgtaaatcttgaagagcccttggcatccacttaccaggatatactttaccaggctaagcaggacaaaatgacaaatgctaaaaacaggacagaaaactcagagagagaaagagatgtttatgaggagctgctcacgcaagctgaaattcaaggcaatataaacaaagtcaatacattttctgcattagcaaatatcgacctggctttagaacaaggagatgcactggccttgttcagggctctgcagtcaccagccctggggcttcgaggactgcagcaacagaatagcgactggtacttgaagcagctcctgagtgataaacagcagaagagacagagtggtcagactgaccccctgcagaaggaggagctgcagtctggagtggatgctgcaaacagtgctgcccagcaatatcagagaagattggcagcagtagcactgattaatgctgcaatccagaagggtgttgctgagaagactgttttggaactgatgaatcccgaagcccagctgccccaggtgtatccatttgccgccgatctctatcagaaggagctggctaccctgcagcgacaaagtcctgaacataatctcacccacccagagctctctgtcgcagtggagatgttgtcatcggtggccctgatcaacagggcattggaatcaggagatgtgaatacagtgtggaagcaattgagcagttcagttactggtcttaccaatattgaggaagaaaactgtcagaggtatctcgatgagttgatgaaactgaaggctcaggcacatgcagagaataatgaattcattacatggaatgatatccaagcttgcgtggaccatgtgaacctggtggtgcaagaggaacatgagaggattttagccattggtttaattaatgaagccctggatgaaggtgatgcccaaaagactctgcaggccctacagattcctgcagctaaacttgagggagtccttgcagaagtggcccagcattaccaagacacgctgattagagcgaagagagagaaagcccaggaaatccaggatgagtcagctgtgttatggttggatgaaattcaaggtggaatctggcagtccaacaaagacacccaagaagcacagaagtttgccttaggaatctttgccattaatgaggcagtagaaagtggtgatgttggcaaaacactgagtgcccttcgctcccctgatgttggcttgtatggagtcatccctgagtgtggtgaaacttaccacagtgatcttgctgaagccaagaagaaaaaactggcagtaggagataataacagcaagtgggtgaagcactgggtaaaaggtggatattattattaccacaatctggagacccaggaaggaggatgggatgaacctccaaattttgtgcaaaattctatgcagctttctcgggaggagatccagagttctatctctggggtgactgccgcatataaccgagaacagctgtggctggccaatgaaggcctgatcaccaggctgcaggctcgctgccgtggatacttagttcgacaggaattccgatccaggatgaatttcctgaagaaacaaatccctgccatcacctgcattcagtcacagtggagaggatacaagcagaagaaggcatatcaagatcggttagcttacctgcgctcccacaaagatgaagttgtaaagattcagtccctggcaaggatgcaccaagctcgaaagcgctatcgagatcgcctgcagtacttccgggaccatataaatgacattatcaaaatccaggcttttattcgggcaaacaaagctcgggatgactacaagactctcatcaatgctgaggatcctcctatggttgtggtccgaaaatttgtccacctgctggaccaaagtgaccaggattttcaggaggagcttgaccttatgaagatgcgggaagaggttatcaccctcattcgttctaaccagcagctggagaatgacctcaatctcatggatatcaaaattggactgctagtgaaaaataagattacgttgcaggatgtggtttcccacagtaaaaaacttaccaaaaaaaataaggaacagttgtctgatatgatgatgataaataaacagaagggaggtctcaaggctttgagcaaggagaagagagagaagttggaagcttaccagcacctgttttatttattgcaaaccaatcccacctatctggccaagctcatttttcagatgccccagaacaagtccaccaagttcatggactctgtaatcttcacactctacaactacgcgtccaaccagcgagaggagtacctgctcctgcggctctttaagacagcactccaagaggaaatcaagtcgaaggtagatcagattcaagagattgtgacaggaaatcctacggttattaaaatggttgtaagtttcaaccgtggtgcccgtggccagaatgccctgagacagatcttggccccagtcgtgaaggaaattatggatgacaaatctctcaacatcaaaactgaccctgtggatatttacaaatcttgggttaatcagatggagtctcagacaggagaggcaagcaaactgccctatgatgtgacccctgagcaggcgctagctcatgaagaagtgaagacacggctagacagctccatcaggaacatgcgggctgtgacagacaagtttctctcagccattgtcagctctgtggacaaaatcccttatgggatgcgcttcattgccaaagtgctgaaggactcgttgcatgagaagttccctgatgctggtgaggatgagctgctgaagattattggtaacttgctttattatcgatacatgaatccagccattgttgctcctgatgcctttgacatcattgacctgtcagcaggaggccagcttaccacagaccaacgccgaaatctgggctccattgcaaaaatgcttcagcatgctgcttccaataagatgtttctgggagataatgcccacttaagcatcattaatgaatatctttcccagtcctaccagaaattcagacggtttttccaaactgcttgtgatgtcccagagcttcaggataaatttaatgtggatgagtactctgatttagtaaccctcaccaaaccagtaatctacatttccattggtgaaatcatcaacacccacactctcctgttggatcaccaggatgccattgctccggagcacaatgatccaatccacgaactgctggacgacctcggcgaggtgcccaccatcgagtccctgataggggaaagctctggcaatttaaatgacccaaataaggaggcactggctaagacggaagtgtctctcaccctgaccaacaagttcgacgtgcctggagatgagaatgcagaaatggatgctcgaaccatcttactgaatacaaaacgtttaattgtggatgtcatccggttccagccaggagagaccttgactgaaatcctagaaacaccagccaccagtgaacaggaagcagaacatcagagagccatgcagagacgtgctatccgtgatgccaaaacacctgacaagatgaaaaagtcaaaatctgtaaaggaagacagcaacctcactcttcaagagaagaaagagaagatccagacaggtttaaagaagctaacagagcttggaaccgtggacccaaagaacaaataccaggaactgatcaacgacattgccagggatattcggaatcagcggaggtaccgacagaggagaaaggccgaactagtgaaactgcaacagacatacgctgctctgaactctaaggccaccttttatggggagcaggtggattactataaaagctatatcaaaacctgcttggataacttagccagcaagggcaaagtctccaaaaagcctagggaaatgaaaggaaagaaaagcaaaaagatttctctgaaatatacagcagcaagactacatgaaaaaggagttcttctggaaattgaggacctgcaagtgaatcagtttaaaaatgttatatttgaaatcagtccaacagaagaagttggagacttcgaagtgaaagccaaattcatgggagttcaaatggagacttttatgttacattatcaggacctgctgcagctacagtatgaaggagttgcagtcatgaaattatttgatagagctaaagtaaatgtcaacctcctgatcttccttctcaacaaaaagttctacgggaagtaattgatcgtttgctgccagcccagaaggatgaaggaaagaagcacctcacagctcctttctaggtccttctttcctcattggaagcaaagacctagccaacaacagcacctcaatctgatacactcccgatgccacatttttaactcctctcgctctgatgggacatttgttacccttttttcatagtgaaattgtgtttcaggcttagtctgacctttctggtttcttcattttcttccattacttaggaaagagtggaaactccactaaaatttctctgtgttgttacagtcttagaggttgcagtactatattgtaagctttggtgtttgtttaattagcaatagggatggtaggattcaaatgtgtgtcatttagaagtggaagctattagcaccaatgacataaatacatacaagacacacaactaaaatgtcatgttattaacagttattaggttgtcatttaaaaataaagttcctttatatttctgtcccatcaggaaaactgaaggatatggggaatcattggttatcttccattgtgtttttctttatggacaggagctaatggaagtgacagtcatgttcaaaggaagcatttctagaaaaaaggagataatgtttttaaatttcattatcaaacttgggcaattctgtttgtgtaactccccgactagtggatgggagagtcccattgctaaaattcagctactcagataaattcagaatgggtcaaggcacctgcctgtttttgttggtgcacagagattgacttgattcagagagacaattcactccatccctatggcagaggaatgggttagccctaatgtagaatgtcattgtttttaaaactgttttatatcttaagagtgccttattaaagtatagatgtatgtcttaaaatgtgggtgataggaattttaaagatttatataatgcatcaaaagccttagaataagaaaagctttttttaaattgctttatctgtatatctgaactcttgaaacttatagctaaaacactaggatttatctgcagtgttcagggagataattctgcctttaattgtctaaaacaaaaacaaaaccagccaacctatgttacacgtgagattaaaaccaattttttccccattttttctccttttttctcttgctgcccacattgtgcctttattttatgagccccagttttctgggcttagtttaaaaaaaaaatcaagtctaaacattgcatttagaaagcttttgttcttggataaaaagtcatacactttaaaaaaaaaaaaaactttttccaggaaaatatattgaaatcatgctgctgagcctctattttctttctttgatgttttgattcagtattcttttatcataaatttttagcatttaaaaattcactgatgtacattaagccaataaactgctttaatgaataacaaactatgtagtgtgtccctattataaatgcattggagaagtatttttatgagactctttactcaggtgcatggttacagcccacagggaggcatggagtgccatggaaggattcgccactacccagaccttgttttttgttgtattttggaagacaggttttttaaagaaacattttcctcagattaaaagatgatgctattacaactagcattgcctcaaaaactgggaccaaccaaagtgtgtcaaccctgtttccttaaaagaggctatgaatcccaaaggccacatccaagacaggcaataatgagcagagtttacagctcctttaataaaatgtgtcagtaattttaaggtttatagttccctcaacacaattgctaatgcagaatagtgtaaaatgcgcttcaagaatgttgatgatgatgatatagaattgtggctttagtagcacagaggatgccccaacaaactcatggcgttgaaaccacacagttctcattactgttatttattagctgtagcattctctgtctcctctctctcctcctttgaccttctcctcgaccagccatcatgacatttaccatgaatttacttcctcccaagagtttggactgcccgtcagattgttgctgcacatagttgcctttgtatctctgtatgaaataaaaggtcatttgttcatgttaaaaaaaaa

SEQ ID NO: 252 - protein, 1657 aa, Homo sapiens
MSAADEVDGLGVARPHYGSVLDNERLTAEEMDERRRQNVAYEYLCHLEEAKRWMEACLGEDLPPTTELEEGLRNGVYLAKLGNFFSPKVVSLKKIYDREQTRYKATGLHFRHTDNVIQWLNAMDEIGLPKIFYPETTDIYDRKNMPRCIYCIHALSLYLFKLGLAPQIQDLYGKVDFTEEEINNMKTELEKYGIQMPAFSKIGGILANELSVDEAALHAAVIAINEAIDRRIPADTFAALKNPNAMLVNLEEPLASTYQDILYQAKQDKMTNAKNRTENSERERDVYEELLTQAEIQGNINKVNTFSALANIDLALEQGDALALFRALQSPALGLRGLQQQNSDWYLKQLLSDKQQKRQSGQTDPLQKEELQSGVDAANSAAQQYQRRLAAVALINAAIQKGVAEKTVLELMNPEAQLPQVYPFAADLYQKELATLQRQSPEHNLTHPELSVAVEMLSSVALINRALESGDVNTVWKQLSSSVTGLTNIEEENCQRYLDELMKLKAQAHAENNEFITWNDIQACVDHVNLVVQEEHERILAIGLINEALDEGDAQKTLQALQIPAAKLEGVLAEVAQHYQDTLIRAKREKAQEIQDESAVLWLDEIQGGIWQSNKDTQEAQKFALGIFAINEAVESGDVGKTLSALRSPDVGLYGVIPECGETYHSDLAEAKKKKLAVGDNNSKWVKHWVKGGYYYYHNLETQEGGWDEPPNFVQNSMQLSREEIQSSISGVTAAYNREQLWLANEGLITRLQARCRGYLVRQEFRSRMNFLKKQIPAITCIQSQWRGYKQKKAYQDRLAYLRSHKDEVVKIQSLARMHQARKRYRDRLQYFRDHINDIIKIQAFIRANKARDDYKTLINAEDPPMVVVRKFVHLLDQSDQDFQEELDLMKMREEVITLIRSNQQLENDLNLMDIKIGLLVKNKITLQDVVSHSKKLTKKNKEQLSDMMMINKQKGGLKALSKEKREKLEAYQHLFYLLQTNPTYLAKLIFQMPQNKSTKFMDSVIFTLYNYASNQREEYLLLRLFKTALQEEIKSKVDQIQEIVTGNPTVIKMVVSFNRGARGQNALRQILAPVVKEIMDDKSLNIKTDPVDIYKSWVNQMESQTGEASKLPYDVTPEQALAHEEVKTRLDSSIRNMRAVTDKFLSAIVSSVDKIPYGMRFIAKVLKDSLHEKFPDAGEDELLKIIGNLLYYRYMNPAIVAPDAFDIIDLSAGGQLTTDQRRNLGSIAKMLQHAASNKMFLGDNAHLSIINEYLSQSYQKFRRFFQTACDVPELQDKFNVDEYSDLVTLTKPVIYISIGEIINTHTLLLDHQDAIAPEHNDPIHELLDDLGEVPTIESLIGESSGNLNDPNKEALAKTEVSLTLTNKFDVPGDENAEMDARTILLNTKRLIVDVIRFQPGETLTEILETPATSEQEAEHQRAMQRRAIRDAKTPDKMKKSKSVKEDSNLTLQEKKEKIQTGLKKLTELGTVDPKNKYQELINDIARDIRNQRRYRQRRKAELVKLQQTYAALNSKATFYGEQVDYYKSYIKTCLDNLASKGKVSKKPREMKGKKSKKISLKYTAARLHEKGVLLEIEDLQVNQFKNVIFEISPTEEVGDFEVKAKFMGVQMETFMLHYQDLLQLQYEGVAVMKLFDRAKVNVNLLIFLLNKKFYGK

SEQ ID NO: 253 - DNA, 3003 bp, Homo sapiens
agaaggtttcatttccgggtggcgcgggcgccattttgtgaggagcgatataaacgggcgcagaggccggctgcccgcccagttgttactcaggtgcgctagcctgcggagcccgtccgtgctgttctgcggcaaggcctttcccagtgtccccacgcggaaggcaactgcctgagaggcgcggcgtcgcaccgcccagagctgaggaagccggcgccagttcgcggggctccgggccgccactcagagctatgagctacggccgcccccctcccgatgtggagggtatgacctccctcaaggtggacaacctgacctaccgcacctcgcccgacacgctgaggcgcgtcttcgagaagtacgggcgcgtcggcgacgtgtacatcccgcgggaccgctacaccaaggagtcccgcggcttcgccttcgttcgctttcacgacaagcgcgacgctgaggacgctatggatgccatggacggggccgtgctggacggccgcgagctgcgggtgcaaatggcgcgctacggccgccccccggactcacaccacagccgccggggaccgccaccccgcaggtacgggggcggtggctacggacgccggagccgcagccctaggcggcgtcgccgcagccgatcccggagtcggagccgttccaggtctcgcagccgatctcgctacagccgctcgaagtctcggtcccgcactcgttctcgatctcggtcgacctccaagtccagatccgcacgaaggtccaagtccaagtcctcgtcggtctccagatctcgttcgcggtccaggtcccggtctcggtccaggagtcctcccccagtgtccaagagggaatccaaatccaggtcgcgatcgaagagtccccccaagtctcctgaagaggaaggagcggtgtcctcttaagaaaatggtaatgtctgggaatccgagacacataaccctaattcataaatgggatttggggtaggtctttttgagtcgtgttaatgtaagaatgactcctatcattaggagtgctgctcggaggttactcacctttgggagtaatactgaagagaggggtctgcagaaaggatgtgtatgaagcttagataataatggctgtttcgtaaactgtttgagacctattaatgaaaatgactatttcttgctgtttttatccaacgtctgcattttccccctttaaagctgcggtctcctgtttgataaaagaatattggccagtattgcagattttaactgatttggctgatcctccagggaccagtttctgtgggcgtgtattggagcaggtttgtctttaaatgttaaagatgcactatcctcttagagaaacaatcagttcaactattgttgtactgactgggacttcatattctaatggatgtggcaaaagaattgcaataagaagcagtgaacatttggaaccccaaaagaaagttacaggtattgcactgggtggggaaaggatagtgtgtctttaactcttaaattgtttggtcctattttttaaaaaggaaagggccctaagtagctcagatattaaagtagtattctcaattaccaaatgtttcatttgaaacaatttatcttaatgaaatatagaccaattctctgatctcgagttgtttttgtttggatacagcccttttttttttctttttttttcttccccttacctttcttcaccttggttatttggccaggaatacgtaaattcaaacttgtacatgctgatggtagcctttgtgaaattttcctaattgggccttttaaaaacatggctgggtggaacatttctgtaccctactggtttgaccagagccttagtaagtacgtgcctgaaactgaaaccatgtgcactttaatggaaggtaagctgaacttctttcttttcaaacctagatgtatcggcaagcagtgtaaacggaggacttggggaaaaaggaccacatagtccatcgaagaagagtccttggaacaagcaactggctattgaaaaggttattttgtaacatttgtctaactttttacttgtttaagctttgcctcagttggcaaacttcattttatgtgccattttgttgctgttattcaaatttcttgtaatttagtgaggtgaacgacttcagatttcattattggatttggatatttgaggtaaaatttcattttgttatatagtgctgactttttttgtttgaaattaaacagattggtaacctaatttgtggcctcctgacttttaaggaaaacgtgtgcagccattacacacagcctaaagctgtcaagagattgactcggcattgccttcattccttaaaattaaaaacctacaaaagttggtgtaaatttgtatatgttatttaccttcagatctaaatggtaatctgaacccaaatttgtataaagacttttcaggtgaaaagacttgattttttgaaaggattgtttatcaaacacaattctaatctcttctcttatgtatttttgtgcactaggcgcagttgtgtagcagttgagtaatgctggttagctgttaaggtggcgtgttgcagtgcagagtgcttggctgtttcctgttttctcccgattgctcctgtgtaaagatgccttgtcgtgcagaaacaaatggctgtccagtttattaaaatgcctgacaactgcacttccagtcacccgggccttgcatataaataacggagcatacagtgagcacatctagctgatgataaatacacctttttttccctcttccccctaaaaatggtaaatctgatcatatctacatgtatgaacttaacatggaaaatgttaaggaagcaaatggttgtaactttgtaagtacttataacatggtgtatctttttgcttatgaatattctgtattataaccattgtttctgtagtttaattaaaacattttcttggtgttagcttttctcagaaaaaaaaaaaaaaaaaaaaaaaaaaaaaaaaaaaaaaaaaa

SEQ ID NO: 254 - protein, 221 aa, Homo sapiens
MSYGRPPPDVEGMTSLKVDNLTYRTSPDTLRRVFEKYGRVGDVYIPRDRYTKESRGFAFVRFHDKRDAEDAMDAMDGAVLDGRELRVQMARYGRPPDSHHSRRGPPPRRYGGGGYGRRSRSPRRRRRSRSRSRSRSRSRSRSRYSRSKSRSRTRSRSRSTSKSRSARRSKSKSSSVSRSRSRSRSRSRSRSPPPVSKRESKSRSRSKSPPKSPEEEGAVSS

SEQ ID NO: 255 - DNA, 9252 bp, Homo sapiens
ggcctgggcgcgtccctgcagcgtggcgggacggccccgttccagtcacccccgcctcgctgcggtggcctcgggcctgggcgcccgccttcagctgcggcggagctggctctgtaaatgccggtgcccgcgagccctcctgaatgcttgtctgcgcccgacgagcgcggcctgtcccgaagctgtccactgccaccactcgggcagtgcttgctttagcctggccctttgcagctgaaaggcgtgacatggtgtcgggtggttcgtgggaagtcggggtttcaggagtccgtgtacttccttgtttgtctttgtcgctggccgacttgtcttcattccaggtggccagagcgagtggggccgggcgttgtcacgggtatcatgatattagctggtttgacatcaagtcatttgtgagtcatcagatcttctcctgaaaatgggagacacagtagggcccctcccaggagctcttggctgttgctgatggcagaagccaagcttgtccaaggttcacttgtagcccctcagcgtcagctcagctggtgtcgtcctgaccatggacggcgcgtcggccgagcaagatggcctccaggaggacagatcccacagtggcccctcgtctctccccgaggccccactgaagcccccgggcccactggtgccacctgaccagcaggacaaagtccagtgtgccgaggtaaacagagcatccacggaaggggaaagcccggatggacctggccagggaggcctctgtcagaacgggccaacgccacccttcccagaccctccgtcgtctctcgatcccaccacaagcccagtgggccctgatgcctctccaggtgtggctggtttccatgacaacctaaggaagtctcagggaactagtgctgagggcagtgttagaaaagaagctttgcagtctctcagactcagtcttcctatgcaagaaacgcaactgtgctctacagattctcccctgcccctggagaaggaggagcaggtccgacttcaggctcggaagtggctggaagagcagctcaaacagtacagggtgaagcgccagcaggagaggtccagtcaacctgcaaccaaaacgagactttttagcacgcttgatcctgagctcatgttaaacccagaaaacttaccaagggccagtaccctggctatgacaaaagaatattccttcctgcgcaccagtgtccctcgggggcctaaggtgggcagcctggggcttccggcacatcctagggagaaaaaaacttccaaatcaagcaaaatccggtctctggccgattacagaactgaagattcaaatgcggggaattctgggggaaatgtcccggctcccgattctaccaagggttccctgaagcagaacagaagcagtgcggcgtccgttgtgtctgagatcagcctgtcccccgacactgacgaccgtctggagaacacctccctggctggagacagcgtgtctgaggtggatggaaatgacagcgacagctcatcgtacagcagcgcctccacccgagggacctatggcattctgtcgaagacagtgggcacgcaggacaccccctatatggtcaacggccaggagattcctgcggataccctgggccagttcccctccattaaggacgtcctccaggccgcagccgctgagcaccaagaccaggggcaggaggtcaacggggaggtgcggagtcggagagacagcatctgcagcagcgtgtccttggagagctctgcagcagaaacacaggaggagatgctgcaggtgctcaaagagaaaatgcgactcgaaggacagctggaagccttgtcactggaggcgagtcaggcacttaaagagaaggctgagctgcaggcccagctggccgccctcagcacgaagctgcaggcgcaggtggagtgcagccacagcagccagcagcggcaggattcgctgagctcggaggtggacaccctgaagcagtcgtgctgggacctggagcgagccatgactgacctgcagaacatgctggaggcaaaaaatgccagcctggcgtcgtccaacaacgacttgcaggtggccgaggagcagtaccagaggcttatggccaaggtagaggacatgcagaggagcatgctcagcaaggacaacacagtgcacgacctgcgacagcagatgacagccttgcagagccagcttcagcaggtgcagctggagcggacgacgctgaccagcaagctgaaggcgtcgcaggcggagatctcgtccctgcagagtgtccggcagtggtaccagcagcagctcgccctggcacaggaggcccgcgtcaggctgcagggtgagatggcccacatccaggttggacagatgacccaggcaggtctcctggagcacctgaaactcgagaatgtgtccctgtcccagcagctgacggaaactcagcacaggtccatgaaggagaaggggcgcatcgcggcacagctgcagggcattgaggctgacatgttggatcaggaagcagccttcatgcagattcaggaggcaaagacgatggtggaggaggaccttcagaggaggctggaagagtttgaaggtgagagggagcggctgcagaggatggcggactcggcggcatccctggagcagcagctggagcaggtgaagttgactttactccagcgagaccagcagcttgaggctttgcagcaggagcacctggacctgatgaaacagctcaccttgactcaggaggctctgcagagcagggagcagtccctcgatgccctgcagacacactacgatgagctgcaggccaggctgggggagctgcagggcgaggccgcctccagggaggacacgatctgcctcctgcagaacgagaagatcatcttggaggcggctttgcaggcggccaagagtggcaaggaggagcttgacagaggagcaagacgcttggaagaaggtaccgaggaaacgtcggaaactttagagaagttaagagaagaattagctatcaaatccggccaggtggaacacctgcagcaggagactgctgctctgaaaaagcaaatgcaaaaaataaaggaacagtttctccaacaaaaggtgatggtggaggcctaccggcgcgacgccacctccaaagaccagctcatcagtgagctgaaagccaccaggaagaggctggactcggagctgaaggagctgcggcaggagctgatgcaagtgcacggggagaagcggactgccgaggcggagctctcgcgcctgcacagagaggtggcccaggtccgtcagcacatggcggaccttgaagggcatctccagtcggcgcagaaggagcgagacgagatggaaacacacttgcagtcgttgcagttcgataaggagcagatggtcgcggtcacagaggccaatgaggcgctgaagaaacaaatcgaagagttgcagcaagaggcccggaaggccatcacggaacagaagcagaagatgaggcggctgggctcagacttgaccagcgcccagaaggagatgaagaccaaacataaggcctacgagaacgccgtgggcatcctcagccgccgcctgcaggaggccctcgcggccaaggaggctgcggacgcggagctgggccagctccgagcccagggtggcagcagtgacagcagcctggctctacatgaaaggatccaggccctggaggcggagctgcaggctgtcagtcatagcaagacgctgctggaaaaggaactgcaggaggtcatagcgctgaccagccaggagctggaggagtcccgggagaaggtgctggagctggaggacgagcttcaagaatccagaggctttaggaagaagataaaacgccttgaggagtcaaacaagaagttggctcttgaattagagcacgagaaagggaagcttacgggcctcggtcagtccaacgcagctctgcgggaacacaacagcatcctagaaacagctttggccaagagggaggcagacctagtccagttgaaccttcaggtgcaggcagttttgcagcgcaaagaagaggaggatcgccagatgaagcatcttgtccaggccctgcaggcctcactagagaaggagaaggagaaggtgaacagcctcaaggagcaggtggctgctgccaaggtggaagccgggcataaccgccgccacttcaaggcggcctccttggagctgagtgaggtgaagaaggagctgcaggccaaggaacacctggtgcagaagctgcaggccgaggccgacgaccttcagattcgggaggggaaacattcccaggagatagcacagttccaagcagagctggccgaggcccgggcacagctccagctcctgcagaagcagctggacgagcagctcagcaaacagcccgtgggaaaccaagagatggaaaatctcaaatgggaggtggatcagaaagaaagagaaatccagtccttgaagcagcagctggacttgacggagcagcagggcaggaaggaactggaagggctacagcagctgctgcagaacgtcaagtctgagttggagatggcccaggaagacctgtccatgacccagaaggataaatttatgctccaggcaaaagtgtcggagctgaagaacaacatgaagaccctgctccagcagaaccagcagctcaagctggacctacgccgcggcgcggccaagacgagaaaggagccgaaaggcgaggccagctcttccaaccctgccacgcccatcaagatcccggactgcccagttcccgcctcgctgctggaggagctgctgagaccaccgcccgccgtgagcaaggagcccctcaagaacctgaacagctgcctccagcagctcaagcaggagatggacagcctgcagcgccagatggaggagcacgccctgacggtgcacgagtctctgtcctcgtggacgccgctggagccagccactgccagccctgtgcccccggggggtcacgccggcccacgcggcgacccacagagacacagtcagagcagggcttccaaagaagggccgggagagtgactgctgtggactcgcctccgtgcgccgctgccccagaaggctcttatcaatgttatttatttgattgtgtggtcgatgtttttctaagacatgaaatttaagttttgttttgcctttaacaagaagtaaaatatatagcagaatgagagccaaggactagaaaaacattcgaagatcacaattagcttttcacatggaatgaccaactcttaaaagcctgataggctctcggcgaggagctttgaacgtgtctgaagggttacttgtaggtcgtggcttctgagcggccaccgatgctgctctctgcgggtgacagggagaggctgcgtaactgggagcagctgtgtgacagggtctgcggcaccgcgcctggccaggccggctgcagtttctcacttccctgttccattcagtaagagctttacttttccgcagaaatgaaattttatctgtacctttggctttttacttgtttttttggatagccatcccaccataggatgtgtacatagatactgaatatcataatccaatctttgttttttttttttttttttttttgagacagagtctcgctttgttgcccaggctggagtgcagtggcacactctccgctcactgcaagctccgcctcccaggttcatgcgattctcctgcctcagcctctcgagtagctgggattacaggcgtgcgccactatgccaggctaatgtttgtatttttagtagcaatggggtttcaccatgttggccaggatggtctcgatctcctgacctcaagtgatctgcccatctcagcctcccaaagtgctgggattacaggcgtgagcccctgcgcccggcctgtcacccagtctttaagaagcatatgctcatgttattgaagaagaacctacttattattgattgccttttgaaaatttgttgggaataatttacctgcaggatttagggatagtcagaaaattctaagaaatataattattttatttaccttctaaagccaaatattcttacacagaaaggtcctctgttgttctggttttactttgttgctgaggatctttccttcctgctggtctcttcctctcaggccactggccctgtgtgattccaccgtggctggccactgggaaggggcagcttggacccttggtcaggcctgacggccatcaggaggcacaaggacactgaggccccatatctgatctgacctttgggggggcacagggagaggccggtggaggaggaggaggagagcagaccaggggctccctgcagcgactcccgcggtttcccctggagtcagccaggtgtaggtcgcaggcggtaacaaacctcacactcctgttccccaagtgaaaatctttaccattgtctgtgggagcgcctgtactcgtgtgtaggagcacctgtacttctgcagtcatcgagaagtcctggatcttttgtggttacaccagcatcatgtggcaagcagaggcgacttccggaagagacaggcaggcaccgtgaggaaggtggctgtgctctcccaggtgtctcagagacagatgccttatttaaaatcagcacgacatgtgtgagatcttctgtttcctaccccaaatcctgaaaccctgcagacactggctgactgggagaggtggggtctgtaagttgtcccctagtttgctaagaaaatctaaaataatatttattatatgagttaggagagagagaatgggtccgcgtggcctcctctgcagatgtactggtctgaaatgaggttctgagtcactggccaggccagatgtgctcatgtcggtgtctggtgtctgttttgtggagaaaacagtatggtgtgttttaagctatttgtgttctgttgtaatatacttttagaaggttaattggtaaggttaaggtagcattaaccacaaagatgtttggtatttaaaaaatattctctagcaaatattggaatttccaaaatatatcatttgtacagggttaattttgaaataatacttgaaaatttcattataaatatatcctactttttatcttaagttgaagatgttatttactaaattgttcttgtaccattagaaaaaaaaatacggcaatttacgttcttatttattttggctgtactacccctttgttttaattttaaaatcaagaaatcgggccgggcgcggtggctcatgcctgtaatcccagcactttgggaggccgaggcgggtggatcacctgaggtcaagaggtccagaccatcctggccaacatggcaaaaccccgtctttactaaacatacaaaaattagccgggtgtcgtagtgcgcacctataatcccagctacttgggaggctgaggcaggagaatcacttgaacccaggaggcggagcttgcagtgagccgagatcgcgccactgccctccagcctgggcaacagagcgagactccgtctcaaaaataaataaatgattttaaaaaatctaaaatcgagaaatcacacattcagtggggagcgacttctccttgcttatgggaagtcctcaagtgagtgatgttcaccatgtatttttttttctcttaggacagactaattctgaaaataccgaaggaaaagtagctctatgttctcaccccggttttcctgcgtgtgtgcccttgggtgcgatgcctcccccagcgctctgtggtcgccggtgccagggccccctctggtttggcagggcctggctgcctttgctccctgcagtgagtcttttggtgttttcatgcacggcttgtgcttctggatctgaggcctctcgtgttcacgcggacacttccttccttaagaagacgcctaaaagaggaagttggaattttttttttttttttttgagacagagtctcgctctgtcgcccaggctggagtgcagtggcgtgatctctgctcactgcaagctccgccatctgggttcaagcgattctcctgcctcattctccccagtagctgggattacaggtgcccgccaccacaccagcctaatttttgtatttttagaggggtggagttccaccatgttggccaggctggtcttgaactcttgacctcaggtgatcctgagcctcagcctcccaaagtgctggaattataggcgtgaaccaccgcccccggctgcagttggatttttaaattgcttttttttattgttgaggtttttttatctccaagggactctcccggcacttctaccttccagagttacttcagtgcataaagtttgaattattttgttcttgtgggcagaagtgggaatgatggaatatcctcacggaaaaggcagtgaagttgggagtactgcttacaaaacagggtcaccagtgcattatgtggcgtgttcatccccacgccgtgtgtcacgggctagggcggcgtgttcatccccacaccgtgtgtcacaacaggctagggcacttcacgatgtcactacttgtttttctgatgttccaaaaacaacgtaacttggttttcatgtgtttttccgtggtatatgtgagattgatgctacgggtcttacggactcacacccgttcccactctctgcaatatggatcaggcagtgtttctgataggatgtgaaatggactctcctcgggtgggtccagcaggggccctgcccaccagaacacagtccgtgctgtgctgcgctaaggagctggccctcaactctccttggtgcagggttcccacaaccgagttctagttccctgaggtctttaaaaacaaaaacagaatgttgtacgtgaagattctaggaggggagggaccagcaaatctgagagaaccgtcctggggcctcccttcgaggagccctctgatgtgaggagggacttgagttgagtgacgctgtggtgtgaggtgttctgagctcactgaccggaaggtccaggtgaatctcgtcataagtgatctcaggctctcacaggatccggagggaaatgtgttagagggtctggaaaattcagtgcttttgagttacttgtttttattaaaaatttcctcacaaaagagagtcctcaagttgtggctgttcttgggaaaggggtcaccgtgtctgacaaagtgtaactttaaaaagcacgttgattttttacaaatgtaagtgtgcttgggaattccttaaattttgtgcaataaactattttttggtaaagattttc

SEQ ID NO: 256 - protein, 1498 aa, Homo sapiens
MDGASAEQDGLQEDRSHSGPSSLPEAPLKPPGPLVPPDQQDKVQCAEVNRASTEGESPDGPGQGGLCQNGPTPPFPDPPSSLDPTTSPVGPDASPGVAGFHDNLRKSQGTSAEGSVRKEALQSLRLSLPMQETQLCSTDSPLPLEKEEQVRLQARKWLEEQLKQYRVKRQQERSSQPATKTRLFSTLDPELMLNPENLPRASTLAMTKEYSFLRTSVPRGPKVGSLGLPAHPREKKTSKSSKIRSLADYRTEDSNAGNSGGNVPAPDSTKGSLKQNRSSAASVVSEISLSPDTDDRLENTSLAGDSVSEVDGNDSDSSSYSSASTRGTYGILSKTVGTQDTPYMVNGQEIPADTLGQFPSIKDVLQAAAAEHQDQGQEVNGEVRSRRDSICSSVSLESSAAETQEEMLQVLKEKMRLEGQLEALSLEASQALKEKAELQAQLAALSTKLQAQVECSHSSQQRQDSLSSEVDTLKQSCWDLERAMTDLQNMLEAKNASLASSNNDLQVAEEQYQRLMAKVEDMQRSMLSKDNTVHDLRQQMTALQSQLQQVQLERTTLTSKLKASQAEISSLQSVRQWYQQQLALAQEARVRLQGEMAHIQVGQMTQAGLLEHLKLENVSLSQQLTETQHRSMKEKGRIAAQLQGIEADMLDQEAAFMQIQEAKTMVEEDLQRRLEEFEGERERLQRMADSAASLEQQLEQVKLTLLQRDQQLEALQQEHLDLMKQLTLTQEALQSREQSLDALQTHYDELQARLGELQGEAASREDTICLLQNEKIILEAALQAAKSGKEELDRGARRLEEGTEETSETLEKLREELAIKSGQVEHLQQETAALKKQMQKIKEQFLQQKVMVEAYRRDATSKDQLISELKATRKRLDSELKELRQELMQVHGEKRTAEAELSRLHREVAQVRQHMADLEGHLQSAQKERDEMETHLQSLQFDKEQMVAVTEANEALKKQIEELQQEARKAITEQKQKMRRLGSDLTSAQKEMKTKHKAYENAVGILSRRLQEALAAKEAADAELGQLRAQGGSSDSSLALHERIQALEAELQAVSHSKTLLEKELQEVIALTSQELEESREKVLELEDELQESRGFRKKIKRLEESNKKLALELEHEKGKLTGLGQSNAALREHNSILETALAKREADLVQLNLQVQAVLQRKEEEDRQMKHLVQALQASLEKEKEKVNSLKEQVAAAKVEAGHNRRHFKAASLELSEVKKELQAKEHLVQKLQAEADDLQIREGKHSQEIAQFQAELAEARAQLQLLQKQLDEQLSKQPVGNQEMENLKWEVDQKEREIQSLKQQLDLTEQQGRKELEGLQQLLQNVKSELEMAQEDLSMTQKDKFMLQAKVSELKNNMKTLLQQNQQLKLDLRRGAAKTRKEPKGEASSSNPATPIKIPDCPVPASLLEELLRPPPAVSKEPLKNLNSCLQQLKQEMDSLQRQMEEHALTVHESLSSWTPLEPATASPVPPGGHAGPRGDPQRHSQSRASKEGPGE

SEQ ID NO: 257 - DNA, 2596 bp, Homo sapiens; identical to SEQ ID NO: 13

SEQ ID NO: 258 - protein, 508 aa, Homo sapiens; identical to SEQ ID NO: 14

SEQ ID NO: 259 - DNA, 2445 bp, Homo sapiens
ataaaagcccaggggcaagcggtccggataacggctagcctgaggagctgctgcgacagtccactacctttttcgagagtgactcccgttgtcccaaggcttcccagagcgaacctgtgcggctgcaggcaccggcgcgtcgagtttccggcgtccggaaggaccgagctcttctcgcggatccagtgttccgtttccagcccccaatctcagagcggagccgacagagagcagggaaccggcatggccaaagccgcggcgatcggcatcgacctgggcaccacctactcctgcgtgggggtgttccaacacggcaaggtggagatcatcgccaacgaccagggcaaccgcaccacccccagctacgtggccttcacggacaccgagcggctcatcggggatgcggccaagaaccaggtggcgctgaacccgcagaacaccgtgtttgacgcgaagcggctgattggccgcaagttcggcgacccggtggtgcagtcggacatgaagcactggcctttccaggtgatcaacgacggagacaagcccaaggtgcaggtgagctacaagggggagaccaaggcattctaccccgaggagatctcgtccatggtgctgaccaagatgaaggagatcgccgaggcgtacctgggctacccggtgaccaacgcggtgatcaccgtgccggcctacttcaacgactcgcagcgccaggccaccaaggatgcgggtgtgatcgcggggctcaacgtgctgcggatcatcaacgagcccacggccgccgccatcgcctacggcctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaggacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggcggacaagaagaaggtgctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctgggggcttcggggctcagggtcccaagggagggtctgggtcaggccccaccattgaggaggtagattaggggcctttccaagattgctgtttttgttttggagcttcaagactttgcatttcctagtatttctgtttgtcagttctcaatttcctgtgtttgcaatgttgaaattttttggtgaagtactgaacttgctttttttccggtttctacatgcagagatgaatttatactgccatcttacgactatttcttctttttaatacacttaactcaggccattttttaagttggttacttcaaagtaaataaactttaaaattcaaaaaaaaaaaaaaaaaa

SEQ ID NO: 260 - protein, 641 aa, Homo sapiens
MAKAAAIGIDLGTTYSCVGVFQHGKVEIIANDQGNRTTPSYVAFTDTERLIGDAAKNQVALNPQNTVFDAKRLIGRKFGDPVVQSDMKHWPFQVINDGDKPKVQVSYKGETKAFYPEEISSMVLTKMKEIAEAYLGYPVTNAVITVPAYFNDSQRQATKDAGVIAGLNVLRIINEPTAAAIAYGLDRTGKGERNVLIFDLGGGTFDVSILTIDDGIFEVKATAGDTHLGGEDFDNRLVNHFVEEFKRKHKKDISQNKRAVRRLRTACERAKRTLSSSTQASLEIDSLFEGIDFYTSITRARFEELCSDLFRSTLEPVEKALRDAKLDKAQIHDLVLVGGSTRIPKVQKLLQDFFNGRDLNKSINPDEAVAYGAAVQAAILMGDKSENVQDLLLLDVAPLSLGLETAGGVMTALIKRNSTIPTKQTQIFTTYSDNQPGVLIQVYEGERAMTKDNNLLGRFELSGIPPAPRGVPQIEVTFDIDANGILNVTATDKSTGKANKITITNDKGRLSKEEIERMVQEAEKYKAEDEVQRERVSAKNALESYAFNMKSAVEDEGLKGKISEADKKKVLDKCQEVISWLDANTLAEKDEFEHKRKELEQVCNPIISGLYQGAGGPGPGGFGAQGPKGGSGSGPTIEEVD

SEQ ID NO: 261 - DNA, 2053 bp, Homo sapiens; identical to SEQ ID NO: 133

SEQ ID NO: 262 - protein, 287 aa, Homo sapiens; identical to SEQ ID NO: 134

SEQ ID NO: 263 - DNA, 2110 bp, Homo sapiens; identical to SEQ ID NO: 131

SEQ ID NO: 264 - protein, 306 aa, Homo sapiens; identical to SEQ ID NO: 132

SEQ ID NO: 265 - DNA, 2200 bp, Homo sapiens; identical to SEQ ID NO: 129

SEQ ID NO: 266 - protein, 336 aa, Homo sapiens; identical to SEQ ID NO: 130

SEQ ID NO: 267 - DNA, 2257 bp, Homo sapiens; identical to SEQ ID NO: 127

SEQ ID NO: 268 - protein, 355 aa, Homo sapiens; identical to SEQ ID NO: 128

SEQ ID NO: 269 - DNA, 1668 bp, Homo sapiens
aggggttacgacccatcagcccttgcgcgccaccgtcccttctctcttcctcggcgctgcctacggaggtggcagccatctccttctcggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaatgtaaaaactgccatctggcatcttccttccttgattttaagtcttcagcttcttggccaacttagtttgccacagagattgttcttttgcttaagcccctttggaatctcccatttggaggggatttgtaaaggacactcagtccttgaacaggggaatgtggcctcaagtgcacagactagccttagtcatctccagttgaggctgggtatgaggggtacagacttggccctcacaccaggtaggttctgagacacttgaagaagcttgtggctcccaagccacaagtagtcattcttagccttgcttttgtaaagttaggtgacaagttattccatgtgatgcttgtgagaattgagaaaatatgcatggaaatatccagatgaatttcttacacagattcttacgggatgcctaaattgcatcctgtaacttctgtccaaaaagaacaggatgatgtacaaattgctcttccaggtaatccaccacggttaactggaaaagcactttcagtctcctataaccctcccaccagctgctgcttcaggtataatgttacagcagtttgccaaggcggggacctaactggtgacaattgagcctcttgactggtactcagaatttagtgacacgtggtcctgattttttttggagacggggtcttgctctcacccaggctgggagtgcagtggcacactgactacagccttgacctccccaggctcaggtgatcttcccacctcagccttccaagtagctgggactacagatgcacacctccaaacctgggtagtttttgaagtttttttgtagaggtggtctagccatgttgcctaggctcccgaactcctgagctcaagcaatcctgcttcagcctcccaaagtactgggattacaggcatcttctgtagtatataggtcatgagggatatgggatgtggtacttatgagacagaaatgcttacaggatgtttttctgtaaccatcctggtcaacttagcagaaatgctgcgctgggtataataaagcttttctacttctagtctagacaggaatcttacagattgtctcctgttcaaaacctagtcataaatatttataatgcaaactggtcaaaaaaaaaaaaaaaaaa

SEQ ID NO: 270 - protein, 135 aa, Homo sapiens [sequence omitted]

SEQ ID NO: 271 - DNA, 1767 bp, Homo sapiens
aggggttacgacccatcagcccttgcgcgccaccgtcccttctctcttcctcggcgctgcctacggaggtggcagccatctccttctcgctggcgattggaagacactctgcgacagtgttcagtccctgggcaggaaagcctccttccaggattcttcctcacctggggccgcttcttccccaaaaggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaatgtaaaaactgccatctggcatcttccttccttgattttaagtcttcagcttcttggccaacttagtttgccacagagattgttcttttgcttaagcccctttggaatctcccatttggaggggatttgtaaaggacactcagtccttgaacaggggaatgtggcctcaagtgcacagactagccttagtcatctccagttgaggctgggtatgaggggtacagacttggccctcacaccaggtaggttctgagacacttgaagaagcttgtggctcccaagccacaagtagtcattcttagccttgcttttgtaaagttaggtgacaagttattccatgtgatgcttgtgagaattgagaaaatatgcatggaaatatccagatgaatttcttacacagattcttacgggatgcctaaattgcatcctgtaacttctgtccaaaaagaacaggatgatgtacaaattgctcttccaggtaatccaccacggttaactggaaaagcactttcagtctcctataaccctcccaccagctgctgcttcaggtataatgttacagcagtttgccaaggcggggacctaactggtgacaattgagcctcttgactggtactcagaatttagtgacacgtggtcctgattttttttggagacggggtcttgctctcacccaggctgggagtgcagtggcacactgactacagccttgacctccccaggctcaggtgatcttcccacctcagccttccaagtagctgggactacagatgcacacctccaaacctgggtagtttttgaagtttttttgtagaggtggtctagccatgttgcctaggctcccgaactcctgagctcaagcaatcctgcttcagcctcccaaagtactgggattacaggcatcttctgtagtatataggtcatgagggatatgggatgtggtacttatgagacagaaatgcttacaggatgtttttctgtaaccatcctggtcaacttagcagaaatgctgcgctgggtataataaagcttttctacttctagtctagacaggaatcttacagattgtctcctgttcaaaacctagtcataaatatttataatgcaaactggtcaaaaaaaaaaaaaaaaaa

SEQ ID NO: 272 - protein, 135 aa, Homo sapiens [sequence omitted]

SEQ ID NO: 273 - DNA, 1787 bp, Homo sapiens
gacctcctgggatcgcatctggagagtgcctagtattctgccagcttcggaaagggagggaaagcaagcctggcagaggcacccattccattcccagcttgctccgtagctggcgattggaagacactctgcgacagtgttcagtccctgggcaggaaagcctccttccaggattcttcctcacctggggccgcttcttccccaaaaggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaatgtaaaaactgccatctggcatcttccttccttgattttaagtcttcagcttcttggccaacttagtttgccacagagattgttcttttgcttaagcccctttggaatctcccatttggaggggatttgtaaaggacactcagtccttgaacaggggaatgtggcctcaagtgcacagactagccttagtcatctccagttgaggctgggtatgaggggtacagacttggccctcacaccaggtaggttctgagacacttgaagaagcttgtggctcccaagccacaagtagtcattcttagccttgcttttgtaaagttaggtgacaagttattccatgtgatgcttgtgagaattgagaaaatatgcatggaaatatccagatgaatttcttacacagattcttacgggatgcctaaattgcatcctgtaacttctgtccaaaaagaacaggatgatgtacaaattgctcttccaggtaatccaccacggttaactggaaaagcactttcagtctcctataaccctcccaccagctgctgcttcaggtataatgttacagcagtttgccaaggcggggacctaactggtgacaattgagcctcttgactggtactcagaatttagtgacacgtggtcctgattttttttggagacggggtcttgctctcacccaggctgggagtgcagtggcacactgactacagccttgacctccccaggctcaggtgatcttcccacctcagccttccaagtagctgggactacagatgcacacctccaaacctgggtagtttttgaagtttttttgtagaggtggtctagccatgttgcctaggctcccgaactcctgagctcaagcaatcctgcttcagcctcccaaagtactgggattacaggcatcttctgtagtatataggtcatgagggatatgggatgtggtacttatgagacagaaatgcttacaggatgtttttctgtaaccatcctggtcaacttagcagaaatgctgcgctgggtataataaagcttttctacttctagtctagacaggaatcttacagattgtctcctgttcaaaacctagtcataaatatttataatgcaaactggtcaaaaaaaaaaaaaaaaaa

SEQ ID NO: 274 - protein, 135 aa, Homo sapiens [sequence omitted]

SEQ ID NO: 275 - DNA, 556 bp, Homo sapiens; identical to SEQ ID NO: 151

SEQ ID NO: 276 - protein, 137 aa, Homo sapiens; identical to SEQ ID NO: 152

SEQ ID NO: 277 - DNA, 628 bp, Homo sapiens; identical to SEQ ID NO: 149

SEQ ID NO: 278 - protein, 161 aa, Homo sapiens; identical to SEQ ID NO: 150

SEQ ID NO: 279 - DNA, 926 bp, Homo sapiens
gatatctctggaatagactgcgctaccctgcgccgccgccgtcaaactcccgcagacttctctgtagatcgctgagcgatactttcggcagcacctccttgattctcagttttgctggaggccgcaaccaggcccgcgccgccaccatgtttcgaaatcagtatgacaatgatgtcactgtttggagcccccagggcaggattcatcaaattgaatatgcaatggaagctgttaaacaaggttcagccacagttggtctgaaatcaaaaactcatgcagttttggttgcattgaaaagggcgcaatcagagcttgcagctcatcagaaaaaaattctccatgttgacaaccatattggtatctcaattgcggggcttactgctgatgctagactgttatgtaattttatgcgtcaggagtgtttggattccagatttgtattcgatagaccactgcctgtgtctcgtcttgtatctctaattggaagcagtatcctttttatgttagcatttatggatatgaactttgaagggttttgatacttgtgttaattattaggaatataataataatatgacataggtaagattgtgaaaactttaaaacaacaaattggattgctctttcattagcctttataagcaatttatatttgctagacacaaataagcccaacttcaggaaaatcatctaagcatctttttagaggggatttaaagtttcttaatggttctagatgtcccaagaaatcctagaccccttgtatccaaaacaaatcaggttttagatgggaagaaattattttgctggcactctttcttaggttcggtagaaagtcaaacattttatattaggccaaagaaatagtgtcctattgcattatttctctggtggattatgcaacaattaaagaataagccagagac

SEQ ID NO: 280 - protein, 130 aa, Homo sapiens
MFRNQYDNDVTVWSPQGRIHQIEYAMEAVKQGSATVGLKSKTHAVLVALKRAQSELAAHQKKILHVDNHIGISIAGLTADARLLCNFMRQECLDSRFVFDRPLPVSRLVSLIGSSILFMLAFMDMNFEGF

SEQ ID NO: 281 - DNA, 1281 bp, Homo sapiens
gatatctctggaatagactgcgctaccctgcgccgccgccgtcaaactcccgcagacttctctgtagatcgctgagcgatactttcggcagcacctccttgattctcagttttgctggaggccgcaaccaggcccgcgccgccaccatgtttcgaaatcagtatgacaatgatgtcactgtttggagcccccagggcaggattcatcaaattgaatatgcaatggaagctgttaaacaaggttcagccacagttggtctgaaatcaaaaactcatgcagttttggttgcattgaaaagggcgcaatcagagcttgcagctcatcagaaaaaaattctccatgttgacaaccatattggtatctcaattgcggggcttactgctgatgctagactgttatgtaattttatgcgtcaggagtgtttggattccagatttgtattcgatagaccactgcctgtgtctcgtcttgtatctctaattggaagcaagacccagataccaacacaacgatatggccggagaccatatggtgttggtctccttattgctggttatgatgatatgggccctcacattttccaaacctgtccatctgctaactattttgactgcagagccatgtccattggagcccgttcccaatcagctcgtacttacttggagagacatatgtctgaatttatggagtgtaatttaaatgaactagttaaacatggtctgcgtgccttaagagagacgcttcctgcagaacaggacctgactacaaagaatgtttccattggaattgttggtaaagacttggagtttacaatctatgatgatgatgatgtgtctccattcctggaaggtcttgaagaaagaccacagagaaaggcacagcctgctcaacctgctgatgaacctgcagaaaaggctgatgaaccaatggaacattaagtgataagccagtctatatatgtattatcaaatatgtaagaatacaggcaccacatactgatgacaataatctatactttgaaccaaaagttgcagagtggtggaatgctatgttttaggaatcagtccagatgtgagttttttccaagcaacctcactgaaacctatataatggaatacatttttctttgaaagggtctgtataatcattttctagaaagtatgggtatctatactaatgtttttatatgaagaacataggtgtctttgtggttttaaagacaactgtgaaataaaattgtttcaccgcctggtaaaaaaaaaaaaaaaaaaaaaaaaaaaa

SEQ ID NO: 282 - protein, 263 aa, Homo sapiens
MFRNQYDNDVTVWSPQGRIHQIEYAMEAVKQGSATVGLKSKTHAVLVALKRAQSELAAHQKKILHVDNHIGISIAGLTADARLLCNFMRQECLDSRFVFDRPLPVSRLVSLIGSKTQIPTQRYGRRPYGVGLLIAGYDDMGPHIFQTCPSANYFDCRAMSIGARSQSARTYLERHMSEFMECNLNELVKHGLRALRETLPAEQDLTTKNVSIGIVGKDLEFTIYDDDDVSPFLEGLEERPQRKAQPAQPADEPAEKADEPMEH

SEQ ID NO: 283 - DNA, 1498 bp, Homo sapiens
cggccgcccaacagggacgcgagccgggaccacgccgacccagcgtgcccaggccgaggaaagcgcggcggcggcagtccgaagacccaccgggactgaaagagaaggacgaggtcatcttcggacgggaggggcaagccagccatcctgggaccccaggcgtgcaggttctctttgagggtattccaccctgcaaaaagcatgtattcatggtcagctctcagcaaggccagtagcagagtggtaaaggccttggccctccaaggctgggaaaagacaatgacaagtcaaatccagacctatgttgtatgttggtctactaggtgactgtctcctggaaatgttatgcagctcagcaaggtgaagtttcgaaatcagtatgacaatgatgtcactgtttggagcccccagggcaggattcatcaaattgaatatgcaatggaagctgttaaacaaggttcagccacagttggtctgaaatcaaaaactcatgcagttttggttgcattgaaaagggcgcaatcagagcttgcagctcatcagaaaaaaattctccatgttgacaaccatattggtatctcaattgcggggcttactgctgatgctagactgttatgtaattttatgcgtcaggagtgtttggattccagatttgtattcgatagaccactgcctgtgtctcgtcttgtatctctaattggaagcaagacccagataccaacacaacgatatggccggagaccatatggtgttggtctccttattgctggttatgatgatatgggccctcacattttccaaacctgtccatctgctaactattttgactgcagagccatgtccattggagcccgttcccaatcagctcgtacttacttggagagacatatgtctgaatttatggagtgtaatttaaatgaactagttaaacatggtctgcgtgccttaagagagacgcttcctgcagaacaggacctgactacaaagaatgtttccattggaattgttggtaaagacttggagtttacaatctatgatgatgatgatgtgtctccattcctggaaggtcttgaagaaagaccacagagaaaggcacagcctgctcaacctgctgatgaacctgcagaaaaggctgatgaaccaatggaacattaagtgataagccagtctatatatgtattatcaaatatgtaagaatacaggcaccacatactgatgacaataatctatactttgaaccaaaagttgcagagtggtggaatgctatgttttaggaatcagtccagatgtgagttttttccaagcaacctcactgaaacctatataatggaatacatttttctttgaaagggtctgtataatcattttctagaaagtatgggtatctatactaatgtttttatatgaagaacataggtgtctttgtggttttaaagacaactgtgaaataaaattgtttcaccgcctggtaaaaaaaaaaaaaaaaaaaaaaaaaaaa

SEQ ID NO: 284 - protein, 269 aa, Homo sapiens
MQLSKVKFRNQYDNDVTVWSPQGRIHQIEYAMEAVKQGSATVGLKSKTHAVLVALKRAQSELAAHQKKILHVDNHIGISIAGLTADARLLCNFMRQECLDSRFVFDRPLPVSRLVSLIGSKTQIPTQRYGRRPYGVGLLIAGYDDMGPHIFQTCPSANYFDCRAMSIGARSQSARTYLERHMSEFMECNLNELVKHGLRALRETLPAEQDLTTKNVSIGIVGKDLEFTIYDDDDVSPFLEGLEERPQRKAQPAQPADEPAEKADEPMEH

SEQ ID NO: 285 - DNA, 3340 bp, Homo sapiens
tgcgggcgtctccgccattttgtgagtctataactcggagccgttgggtcggttcctgctattccggcgcctccactccgtcccccgcgggtctgctctgtgtgccatggacggcattgtcccagatatagccgttggtacaaagcggggatctgacgagcttttctctacttgtgtcactaacggaccgtttatcatgagcagcaactcggcttctgcagcaaacggaaatgacagcaagaagttcaaaggtgacagccgaagtgcaggcgtcccctctagagtgatccacatccggaagctccccatcgacgtcacggagggggaagtcatctccctggggctgccctttgggaaggtcaccaacctcctgatgctgaaggggaaaaaccaggccttcatcgagatgaacacggaggaggctgccaacaccatggtgaactactacacctcggtgacccctgtgctgcgcggccagcccatctacatccagttctccaaccacaaggagctgaagaccgacagctctcccaaccaggcgcgggcccaggcggccctgcaggcggtgaactcggtccagtcggggaacctggccttggctgcctcggcggcggccgtggacgcagggatggcgatggccgggcagagccccgtgctcaggatcatcgtggagaacctcttctaccctgtgaccctggatgtgctgcaccagattttctccaagttcggcacagtgttgaagatcatcaccttcaccaagaacaaccagttccaggccctgctgcagtatgcggaccccgtgagcgcccagcacgccaagctgtcgctggacgggcagaacatctacaacgcctgctgcacgctgcgcatcgacttttccaagctcaccagcctcaacgtcaagtacaacaatgacaagagccgtgactacacacgcccagacctgccttccggggacagccagccctcgctggaccagaccatggccgcggccttcggtgcacctggtataatctcagcctctccgtatgcaggagctggtttccctcccacctttgccattcctcaagctgcaggcctttccgttccgaacgtccacggcgccctggcccccctggccatcccctcggcggcggcggcagctgcggcggcaggtcggatcgccatcccgggcctggcgggggcaggaaattctgtattgctggtcagcaacctcaacccagagagagtcacaccccaaagcctctttattcttttcggcgtctacggtgacgtgcagcgcgtgaagatcctgttcaataagaaggagaacgccctagtgcagatggcggacggcaaccaggcccagctggccatgagccacctgaacgggcacaagctgcacgggaagcccatccgcatcacgctctcgaagcaccagaacgtgcagctgccccgcgagggccaggaggaccagggcctgaccaaggactacggcaactcacccctgcaccgcttcaagaagccgggctccaagaacttccagaacatattcccgccctcggccacgctgcacctctccaacatcccgccctcagtctccgaggaggatctcaaggtcctgttttccagcaatgggggcgtcgtcaaaggattcaagttcttccagaaggaccgcaagatggcactgatccagatgggctccgtggaggaggcggtccaggccctcattgacctgcacaaccacgacctcggggagaaccaccacctgcgggtctccttctccaagtccaccatctaggggcacaggcccccacggccgggccccctggcgacaacttccatcattccagagaaaagccactttaaaaacagctgaagtgaccttagcagaccagagattttatttttttaaagagaaatcagtttacctgtttttaaaaaaattaaatctagttcaccttgctcaccctgcggtgacagggacagctcaggctcttggtgactgtggcagcgggagttcccggccctccacacccggggccagaccctcggggccatgccttggtggggcctgtgtcgggcgtggggcctgcaggtgggcgccccgaccacgacttggcttccttgtgccttaaaaaacctgccttcctgcagccacacacccacccggggtgtcctggggacccaaggggtgggggggtcacaccagagagaggcagggggcctggccggctcctgcaggatcatgcagctggggcgcggcggccgcggctgcgacaccccaaccccagccctctaatcaagtcacgtgattctcccttcaccccgcccccagggccttcccttctgcccccaggcgggctccccgctgctccagctgcggagctggtcgacataatctctgtattatatactttgcagttgcagacgtctgtgcctagcaatatttccagttgaccaaatattctaatcttttttcatttatatgcaaaagaaatagttttaagtaactttttatagcaagatgatacaatggtatgagtgtaatctaaacttccttgtggtattaccttgtatgctgttacttttattttattccttgtaattaagtcacaggcaggacccagtttccagagagcaggcggggccgcccagtgggtcaggcacagggagccccggtcctatcttagagcccctgagcttcagggaaggggcgggcgtgtcgccgcctctggcatcgcctccggttgccttacaccacgccttcacctgcagtcgcctagaaaacttgctctcaaacttcagggttttttcttccttcaaattttggaccaaagtctcatttctgtgttttgcctgcctctgatgctgggacccggaaggcgggcgctcctcctgtcttctctgtgctctttctaccgcccccgcgtcctgtcccgggggctctcctaggatcccctttccgtaaaagcgtgtaacaagggtgtaaatatttataattttttatacctgttgtgagacccgaggggcggcggcgcggttttttatggtgacacaaatgtatattttgctaacagcaattccaggctcagtattgtgaccgcggagccacaggggaccccacgcacattccgttgccttacccgatggcttgtgacgcggagagaaccgattaaaaccgtttgagaaactcctcccttgtctagccctgtgttcgctgtggacgctgtagaggcaggttggccagtctgtacctggacttcgaataaatcttctgtatcctcgctccgttccgccttaaaaaaaaaaaaaaaaaaaaaaaaaaaaaaaaaaaaaaaaaaaaaaaaaaaaaaaaaaa

SEQ ID NO: 286 - protein, 557 aa, Homo sapiens
MDGIVPDIAVGTKRGSDELFSTCVTNGPFIMSSNSASAANGNDSKKFKGDSRSAGVPSRVIHIRKLPIDVTEGEVISLGLPFGKVTNLLMLKGKNQAFIEMNTEEAANTMVNYYTSVTPVLRGQPIYIQFSNHKELKTDSSPNQARAQAALQAVNSVQSGNLALAASAAAVDAGMAMAGQSPVLRIIVENLFYPVTLDVLHQIFSKFGTVLKIITFTKNNQFQALLQYADPVSAQHAKLSLDGQNIYNACCTLRIDFSKLTSLNVKYNNDKSRDYTRPDLPSGDSQPSLDQTMAAAFGAPGIISASPYAGAGFPPTFAIPQAAGLSVPNVHGALAPLAIPSAAAAAAAAGRIAIPGLAGAGNSVLLVSNLNPERVTPQSLFILFGVYGDVQRVKILFNKKENALVQMADGNQAQLAMSHLNGHKLHGKPIRITLSKHQNVQLPREGQEDQGLTKDYGNSPLHRFKKPGSKNFQNIFPPSATLHLSNIPPSVSEEDLKVLFSSNGGVVKGFKFFQKDRKMALIQMGSVEEAVQALIDLHNHDLGENHHLRVSFSKSTI

SEQ ID NO: 287 - DNA, 3319 bp, Homo sapiens
tgcgggcgtctccgccattttgtgagtctataactcggagccgttgggtcggttcctgctattccggcgcctccactccgtcccccgcgggtctgctctgtgtgccatggacggcattgtcccagatatagccgttggtacaaagcggggatctgacgagcttttctctacttgtgtcactaacggaccgtttatcatgagcagcaactcggcttctgcagcaaacggaaatgacagcaagaagttcaaaggtgacagccgaagtgcaggcgtcccctctagagtgatccacatccggaagctccccatcgacgtcacggagggggaagtcatctccctggggctgccctttgggaaggtcaccaacctcctgatgctgaaggggaaaaaccaggccttcatcgagatgaacacggaggaggctgccaacaccatggtgaactactacacctcggtgacccctgtgctgcgcggccagcccatctacatccagttctccaaccacaaggagctgaagaccgacagctctcccaaccaggcgcgggcccaggcggccctgcaggcggtgaactcggtccagtcggggaacctggccttggctgcctcggcggcggccgtggacgcagggatggcgatggccgggcagagccccgtgctcaggatcatcgtggagaacctcttctaccctgtgaccctggatgtgctgcaccagattttctccaagttcggcacagtgttgaagatcatcaccttcaccaagaacaaccagttccaggccctgctgcagtatgcggaccccgtgagcgcccagcacgccaagctgtcgctggacgggcagaacatctacaacgcctgctgcacgctgcgcatcgacttttccaagctcaccagcctcaacgtcaagtacaacaatgacaagagccgtgactacacacgcccagacctgccttccggggacagccagccctcgctggaccagaccatggccgcggccttcgcctctccgtatgcaggagctggtttccctcccacctttgccattcctcaagctgcaggcctttccgttccgaacgtccacggcgccctggcccccctggccatcccctcggcggcggcggcagctgcggcggcaggtcggatcgccatcccgggcctggcgggggcaggaaattctgtattgctggtcagcaacctcaacccagagagagtcacaccccaaagcctctttattcttttcggcgtctacggtgacgtgcagcgcgtgaagatcctgttcaataagaaggagaacgccctagtgcagatggcggacggcaaccaggcccagctggccatgagccacctgaacgggcacaagctgcacgggaagcccatccgcatcacgctctcgaagcaccagaacgtgcagctgccccgcgagggccaggaggaccagggcctgaccaaggactacggcaactcacccctgcaccgcttcaagaagccgggctccaagaacttccagaacatattcccgccctcggccacgctgcacctctccaacatcccgccctcagtctccgaggaggatctcaaggtcctgttttccagcaatgggggcgtcgtcaaaggattcaagttcttccagaaggaccgcaagatggcactgatccagatgggctccgtggaggaggcggtccaggccctcattgacctgcacaaccacgacctcggggagaaccaccacctgcgggtctccttctccaagtccaccatctaggggcacaggcccccacggccgggccccctggcgacaacttccatcattccagagaaaagccactttaaaaacagctgaagtgaccttagcagaccagagattttatttttttaaagagaaatcagtttacctgtttttaaaaaaattaaatctagttcaccttgctcaccctgcggtgacagggacagctcaggctcttggtgactgtggcagcgggagttcccggccctccacacccggggccagaccctcggggccatgccttggtggggcctgtgtcgggcgtggggcctgcaggtgggcgccccgaccacgacttggcttccttgtgccttaaaaaacctgccttcctgcagccacacacccacccggggtgtcctggggacccaaggggtgggggggtcacaccagagagaggcagggggcctggccggctcctgcaggatcatgcagctggggcgcggcggccgcggctgcgacaccccaaccccagccctctaatcaagtcacgtgattctcccttcaccccgcccccagggccttcccttctgcccccaggcgggctccccgctgctccagctgcggagctggtcgacataatctctgtattatatactttgcagttgcagacgtctgtgcctagcaatatttccagttgaccaaatattctaatcttttttcatttatatgcaaaagaaatagttttaagtaactttttatagcaagatgatacaatggtatgagtgtaatctaaacttccttgtggtattaccttgtatgctgttacttttattttattccttgtaattaagtcacaggcaggacccagtttccagagagcaggcggggccgcccagtgggtcaggcacagggagccccggtcctatcttagagcccctgagcttcagggaaggggcgggcgtgtcgccgcctctggcatcgcctccggttgccttacaccacgccttcacctgcagtcgcctagaaaacttgctctcaaacttcagggttttttcttccttcaaattttggaccaaagtctcatttctgtgttttgcctgcctctgatgctgggacccggaaggcgggcgctcctcctgtcttctctgtgctctttctaccgcccccgcgtcctgtcccgggggctctcctaggatcccctttccgtaaaagcgtgtaacaagggtgtaaatatttataattttttatacctgttgtgagacccgaggggcggcggcgcggttttttatggtgacacaaatgtatattttgctaacagcaattccaggctcagtattgtgaccgcggagccacaggggaccccacgcacattccgttgccttacccgatggcttgtgacgcggagagaaccgattaaaaccgtttgagaaactcctcccttgtctagccctgtgttcgctgtggacgctgtagaggcaggttggccagtctgtacctggacttcgaataaatcttctgtatcctcgctccgttccgccttaaaaaaaaaaaaaaaaaaaaaaaaaaaaaaaaaaaaaaaaaaaaaaaaaaaaaaaaaaa

SEQ ID NO: 288 - protein, 550 aa, Homo sapiens
MDGIVPDIAVGTKRGSDELFSTCVTNGPFIMSSNSASAANGNDSKKFKGDSRSAGVPSRVIHIRKLPIDVTEGEVISLGLPFGKVTNLLMLKGKNQAFIEMNTEEAANTMVNYYTSVTPVLRGQPIYIQFSNHKELKTDSSPNQARAQAALQAVNSVQSGNLALAASAAAVDAGMAMAGQSPVLRIIVENLFYPVTLDVLHQIFSKFGTVLKIITFTKNNQFQALLQYADPVSAQHAKLSLDGQNIYNACCTLRIDFSKLTSLNVKYNNDKSRDYTRPDLPSGDSQPSLDQTMAAAFASPYAGAGFPPTFAIPQAAGLSVPNVHGALAPLAIPSAAAAAAAAGRIAIPGLAGAGNSVLLVSNLNPERVTPQSLFILFGVYGDVQRVKILFNKKENALVQMADGNQAQLAMSHLNGHKLHGKPIRITLSKHQNVQLPREGQEDQGLTKDYGNSPLHRFKKPGSKNFQNIFPPSATLHLSNIPPSVSEEDLKVLFSSNGGVVKGFKFFQKDRKMALIQMGSVEEAVQALIDLHNHDLGENHHLRVSFSKSTI

SEQ ID NO: 289 - DNA, 3262 bp, Homo sapiens
tgcgggcgtctccgccattttgtgagtctataactcggagccgttgggtcggttcctgctattccggcgcctccactccgtcccccgcgggtctgctctgtgtgccatggacggcattgtcccagatatagccgttggtacaaagcggggatctgacgagcttttctctacttgtgtcactaacggaccgtttatcatgagcagcaactcggcttctgcagcaaacggaaatgacagcaagaagttcaaaggtgacagccgaagtgcaggcgtcccctctagagtgatccacatccggaagctccccatcgacgtcacggagggggaagtcatctccctggggctgccctttgggaaggtcaccaacctcctgatgctgaaggggaaaaaccaggccttcatcgagatgaacacggaggaggctgccaacaccatggtgaactactacacctcggtgacccctgtgctgcgcggccagcccatctacatccagttctccaaccacaaggagctgaagaccgacagctctcccaaccaggcgcgggcccaggcggccctgcaggcggtgaactcggtccagtcggggaacctggccttggctgcctcggcggcggccgtggacgcagggatggcgatggccgggcagagccccgtgctcaggatcatcgtggagaacctcttctaccctgtgaccctggatgtgctgcaccagattttctccaagttcggcacagtgttgaagatcatcaccttcaccaagaacaaccagttccaggccctgctgcagtatgcggaccccgtgagcgcccagcacgccaagctgtcgctggacgggcagaacatctacaacgcctgctgcacgctgcgcatcgacttttccaagctcaccagcctcaacgtcaagtacaacaatgacaagagccgtgactacacacgcccagacctgccttccggggacagccagccctcgctggaccagaccatggccgcggccttcggcctttccgttccgaacgtccacggcgccctggcccccctggccatcccctcggcggcggcggcagctgcggcggcaggtcggatcgccatcccgggcctggcgggggcaggaaattctgtattgctggtcagcaacctcaacccagagagagtcacaccccaaagcctctttattcttttcggcgtctacggtgacgtgcagcgcgtgaagatcctgttcaataagaaggagaacgccctagtgcagatggcggacggcaaccaggcccagctggccatgagccacctgaacgggcacaagctgcacgggaagcccatccgcatcacgctctcgaagcaccagaacgtgcagctgccccgcgagggccaggaggaccagggcctgaccaaggactacggcaactcacccctgcaccgcttcaagaagccgggctccaagaacttccagaacatattcccgccctcggccacgctgcacctctccaacatcccgccctcagtctccgaggaggatctcaaggtcctgttttccagcaatgggggcgtcgtcaaaggattcaagttcttccagaaggaccgcaagatggcactgatccagatgggctccgtggaggaggcggtccaggccctcattgacctgcacaaccacgacctcggggagaaccaccacctgcgggtctccttctccaagtccaccatctaggggcacaggcccccacggccgggccccctggcgacaacttccatcattccagagaaaagccactttaaaaacagctgaagtgaccttagcagaccagagattttatttttttaaagagaaatcagtttacctgtttttaaaaaaattaaatctagttcaccttgctcaccctgcggtgacagggacagctcaggctcttggtgactgtggcagcgggagttcccggccctccacacccggggccagaccctcggggccatgccttggtggggcctgtgtcgggcgtggggcctgcaggtgggcgccccgaccacgacttggcttccttgtgccttaaaaaacctgccttcctgcagccacacacccacccggggtgtcctggggacccaaggggtgggggggtcacaccagagagaggcagggggcctggccggctcctgcaggatcatgcagctggggcgcggcggccgcggctgcgacaccccaaccccagccctctaatcaagtcacgtgattctcccttcaccccgcccccagggccttcccttctgcccccaggcgggctccccgctgctccagctgcggagctggtcgacataatctctgtattatatactttgcagttgcagacgtctgtgcctagcaatatttccagttgaccaaatattctaatcttttttcatttatatgcaaaagaaatagttttaagtaactttttatagcaagatgatacaatggtatgagtgtaatctaaacttccttgtggtattaccttgtatgctgttacttttattttattccttgtaattaagtcacaggcaggacccagtttccagagagcaggcggggccgcccagtgggtcaggcacagggagccccggtcctatcttagagcccctgagcttcagggaaggggcgggcgtgtcgccgcctctggcatcgcctccggttgccttacaccacgccttcacctgcagtcgcctagaaaacttgctctcaaacttcagggttttttcttccttcaaattttggaccaaagtctcatttctgtgttttgcctgcctctgatgctgggacccggaaggcgggcgctcctcctgtcttctctgtgctctttctaccgcccccgcgtcctgtcccgggggctctcctaggatcccctttccgtaaaagcgtgtaacaagggtgtaaatatttataattttttatacctgttgtgagacccgaggggcggcggcgcggttttttatggtgacacaaatgtatattttgctaacagcaattccaggctcagtattgtgaccgcggagccacaggggaccccacgcacattccgttgccttacccgatggcttgtgacgcggagagaaccgattaaaaccgtttgagaaactcctcccttgtctagccctgtgttcgctgtggacgctgtagaggcaggttggccagtctgtacctggacttcgaataaatcttctgtatcctcgctccgttccgccttaaaaaaaaaaaaaaaaaaaaaaaaaaaaaaaaaaaaaaaaaaaaaaaaaaaaaaaaaaa

SEQ ID NO: 290 - protein, 531 aa, Homo sapiens
MDGIVPDIAVGTKRGSDELFSTCVTNGPFIMSSNSASAANGNDSKKFKGDSRSAGVPSRVIHIRKLPIDVTEGEVISLGLPFGKVTNLLMLKGKNQAFIEMNTEEAANTMVNYYTSVTPVLRGQPIYIQFSNHKELKTDSSPNQARAQAALQAVNSVQSGNLALAASAAAVDAGMAMAGQSPVLRIIVENLFYPVTLDVLHQIFSKFGTVLKIITFTKNNQFQALLQYADPVSAQHAKLSLDGQNIYNACCTLRIDFSKLTSLNVKYNNDKSRDYTRPDLPSGDSQPSLDQTMAAAFGLSVPNVHGALAPLAIPSAAAAAAAAGRIAIPGLAGAGNSVLLVSNLNPERVTPQSLFILFGVYGDVQRVKILFNKKENALVQMADGNQAQLAMSHLNGHKLHGKPIRITLSKHQNVQLPREGQEDQGLTKDYGNSPLHRFKKPGSKNFQNIFPPSATLHLSNIPPSVSEEDLKVLFSSNGGVVKGFKFFQKDRKMALIQMGSVEEAVQALIDLHNHDLGENHHLRVSFSKSTI

SEQ ID NO: 291 - DNA, 3499 bp, Homo sapiens
cggctcagagctccggaccgcgggcggaggggaggggcagggggcggtgccacggcctgccagcccgcccgcccgcccgccagccagccctccccgcggccggctcggctccttggcgctgcctggggtcctttccgcccggtccccgcttgccagcccccgctgctctgtgccctgtccggccaggcctggagccgacaccaccgccatcatgccggccgtgtccaagggcgatgggatgcgggggctcgcggtgttcatctccgacatccggaactgtaagagcaaagaggcggaaattaagagaatcaacaaggaactggccaacatccgctccaagttcaaaggagacaaagccttggatggctacagtaagaaaaaatatgtgtgtaaactgcttttcatcttcctgcttggccatgacattgactttgggcacatggaggctgtgaatctgttgagttccaataaatacacagagaagcaaataggttacctgttcatttctgtgctggtgaactcgaactcggagctgatccgcctcatcaacaacgccatcaagaatgacctggccagccgcaaccccaccttcatgtgcctggccctgcactgcatcgccaacgtgggcagccgggagatgggcgaggcctttgccgctgacatcccccgcatcctggtggccggggacagcatggacagtgtcaagcagagtgcggccctgtgcctccttcgactgtacaaggcctcgcctgacctggtgcccatgggcgagtggacggcgcgtgtggtacacctgctcaatgaccagcacatgggtgtggtcacggccgccgtcagcctcatcacctgtctctgcaagaagaacccagatgacttcaagacgtgcgtctctctggctgtgtcgcgcctgagccggatcgtctcctctgcctccaccgacctccaggactacacctactacttcgtcccagcaccctggctctcggtgaagctcctgcggctgctgcagtgctacccgcctccagaggatgcggctgtgaaggggcggctggtggaatgtctggagactgtgctcaacaaggcccaggagccccccaaatccaagaaggtgcagcattccaacgccaagaacgccatcctcttcgagaccatcagcctcatcatccactatgacagtgagcccaacctcctggttcgggcctgcaaccagctgggccagttcctgcagcaccgggagaccaacctgcgctacctggccctggagagcatgtgcacgctggccagctccgagttctcccatgaagccgtcaagacgcacattgacaccgtcatcaatgccctcaagacggagcgggacgtcagcgtgcggcagcgggcggctgacctcctctacgccatgtgtgaccggagcaatgccaagcagatcgtgtcggagatgctgcggtacctggagacggcagactacgccatccgcgaggagatcgtcctgaaggtggccatcctggccgagaagtacgccgtggactacagctggtacgtggacaccatcctcaacctcatccgcattgcgggcgactacgtgagtgaggaggtgtggtaccgtgtgctacagatcgtcaccaaccgtgatgacgtccagggctatgccgccaagaccgtctttgaggcgctccaggcccctgcctgtcacgagaacatggtgaaggttggcggctacatccttggggagtttgggaacctgattgctggggacccccgctccagccccccagtgcagttctccctgctccactccaagttccatctgtgcagcgtggccacgcgggcgctgctgctgtccacctacatcaagttcatcaacctcttccccgagaccaaggccaccatccagggcgtcctgcgggccggctcccagctgcgcaatgctgacgtggagctgcagcagcgagccgtggagtacctcaccctcagctcagtggccagcaccgacgtcctggccacggtgctggaggagatgccgcccttccccgagcgcgagtcgtccatcctggccaagctgaaacgcaagaaggggccaggggccggcagcgccctggacgatggccggagggaccccagcagcaacgacatcaacgggggcatggagcccacccccagcactgtgtcgacgccctcgccctccgccgacctcctggggctgcgggcagcccctcccccggcagcacccccggcttctgcaggagcagggaaccttctggtggacgtcttcgatggcccggccgcccagcccagcctggggcccacccccgaggaggccttcctcagcgagctggagccgcctgcccccgagagccccatggctttgctggctgacccagctccagctgctgacccaggtcctgaggacatcggccctcccattccggaagccgatgagttgctgaataagtttgtgtgtaagaacaacggggtcctgttcgagaaccagctgctgcagatcggagtcaagtcagagttccgacagaacctgggccgcatgtatctcttctatggcaacaagacctcggtgcagttccagaatttctcacccactgtggttcacccgggagacctccagactcagctggctgtgcagaccaagcgcgtggcggcgcaggtggacggcggcgcgcaggtgcagcaggtgctcaatatcgagtgcctgcgggacttcctgacgcccccgctgctgtccgtgcgcttccggtacggtggcgccccccaggccctcaccctgaagctcccagtgaccatcaacaagttcttccagcccaccgagatggcggcccaggatttcttccagcgctggaagcagctgagcctccctcaacaggaggcgcagaaaatcttcaaagccaaccaccccatggacgcagaagttactaaggccaagcttctggggtttggctctgctctcctggacaatgtggaccccaaccctgagaacttcgtgggggcggggatcatccagactaaagccctgcaggtgggctgtctgcttcggctggagcccaatgcccaggcccagatgtaccggctgaccctgcgcaccagcaaggagcccgtctcccgtcacctgtgtgagctgctggcacagcagttctgagccctggactctgccccgggggatgtggccggcactgggcagccccttggactgaggcagttttggtggatgggggacctccactggtgacagagaagacaccagggtttgggggatgcctgggactttcctccggccttttgtatttttatttttgttcatctgctgctgtttacattctggggggttagggggagtccccctccctccctttcccccccaagcacagaggggagaggggccagggaagtggatgtctcctcccctcccaccccaccctgttgtagcccctcctaccccctccccatccaggggctgtgtattattgtgagcgaataaacagagagacgctaa

SEQ ID NO: 292 - protein, 977 aa, Homo sapiens
MPAVSKGDGMRGLAVFISDIRNCKSKEAEIKRINKELANIRSKFKGDKALDGYSKKKYVCKLLFIFLLGHDIDFGHMEAVNLLSSNKYTEKQIGYLFISVLVNSNSELIRLINNAIKNDLASRNPTFMCLALHCIANVGSREMGEAFAADIPRILVAGDSMDSVKQSAALCLLRLYKASPDLVPMGEWTARVVHLLNDQHMGVVTAAVSLITCLCKKNPDDFKTCVSLAVSRLSRIVSSASTDLQDYTYYFVPAPWLSVKLLRLLQCYPPPEDAAVKGRLVECLETVLNKAQEPPKSKKVQHSNAKNAILFETISLIIHYDSEPNLLVRACNQLGQFLQHRETNLRYLALESMCTLASSEFSHEAVKTHIDTVINALKTERDVSVRQRAADLLYAMCDRSNAKQIVSEMLRYLETADYAIREEIVLKVAILAEKYAVDYSWYVDTILNLIRIAGDYVSEEVWYRVLQIVTNRDDVQGYAAKTVFEALQAPACHENMVKVGGYILGEFGNLIAGDPRSSPPVQFSLLHSKFHLCSVATRALLLSTYIKFINLFPETKATIQGVLRAGSQLRNADVELQQRAVEYLTLSSVASTDVLATVLEEMPPFPERESSILAKLKRKKGPGAGSALDDGRRDPSSNDINGGMEPTPSTVSTPSPSADLLGLRAAPPPAAPPASAGAGNLLVDVFDGPAAQPSLGPTPEEAFLSELEPPAPESPMALLADPAPAADPGPEDIGPPIPEADELLNKFVCKNNGVLFENQLLQIGVKSEFRQNLGRMYLFYGNKTSVQFQNFSPTVVHPGDLQTQLAVQTKRVAAQVDGGAQVQQVLNIECLRDFLTPPLLSVRFRYGGAPQALTLKLPVTINKFFQPTEMAAQDFFQRWKQLSLPQQEAQKIFKANHPMDAEVTKAKLLGFGSALLDNVDPNPENFVGAGIIQTKALQVGCLLRLEPNAQAQMYRLTLRTSKEPVSRHLCELLAQQF

SEQ ID NO: 293 - DNA, 3433 bp, Homo sapiens
cggctcagagctccggaccgcgggcggaggggaggggcagggggcggtgccacggcctgccagcccgcccgcccgcccgccagccagccctccccgcggccggctcggctccttggcgctgcctggggtcctttccgcccggtccccgcttgccagcccccgctgctctgtgccctgtccggccaggcctggagccgacaccaccgccatcatgccggccgtgtccaagggcgatgggatgcgggggctcgcggtgttcatctccgacatccggaactgtaagagcaaagaggcggaaattaagagaatcaacaaggaactggccaacatccgctccaagttcaaaggagacaaagccttggatggctacagtaagaaaaaatatgtgtgtaaactgcttttcatcttcctgcttggccatgacattgactttgggcacatggaggctgtgaatctgttgagttccaataaatacacagagaagcaaataggttacctgttcatttctgtgctggtgaactcgaactcggagctgatccgcctcatcaacaacgccatcaagaatgacctggccagccgcaaccccaccttcatgtgcctggccctgcactgcatcgccaacgtgggcagccgggagatgggcgaggcctttgccgctgacatcccccgcatcctggtggccggggacagcatggacagtgtcaagcagagtgcggccctgtgcctccttcgactgtacaaggcctcgcctgacctggtgcccatgggcgagtggacggcgcgtgtggtacacctgctcaatgaccagcacatgggtgtggtcacggccgccgtcagcctcatcacctgtctctgcaagaagaacccagatgacttcaagacgtgcgtctctctggctgtgtcgcgcctgagccggatcgtctcctctgcctccaccgacctccaggactacacctactacttcgtcccagcaccctggctctcggtgaagctcctgcggctgctgcagtgctacccgcctccagaggatgcggctgtgaaggggcggctggtggaatgtctggagactgtgctcaacaaggcccaggagccccccaaatccaagaaggtgcagcattccaacgccaagaacgccatcctcttcgagaccatcagcctcatcatccactatgacagtgagcccaacctcctggttcgggcctgcaaccagctgggccagttcctgcagcaccgggagaccaacctgcgctacctggccctggagagcatgtgcacgctggccagctccgagttctcccatgaagccgtcaagacgcacattgacaccgtcatcaatgccctcaagacggagcgggacgtcagcgtgcggcagcgggcggctgacctcctctacgccatgtgtgaccggagcaatgccaagcagatcgtgtcggagatgctgcggtacctggagacggcagactacgccatccgcgaggagatcgtcctgaaggtggccatcctggccgagaagtacgccgtggactacagctggtacgtggacaccatcctcaacctcatccgcattgcgggcgactacgtgagtgaggaggtgtggtaccgtgtgctacagatcgtcaccaaccgtgatgacgtccagggctatgccgccaagaccgtctttgaggcgctccaggcccctgcctgtcacgagaacatggtgaaggttggcggctacatccttggggagtttgggaacctgattgctggggacccccgctccagccccccagtgcagttctccctgctccactccaagttccatctgtgcagcgtggccacgcgggcgctgctgctgtccacctacatcaagttcatcaacctcttccccgagaccaaggccaccatccagggcgtcctgcgggccggctcccagctgcgcaatgctgacgtggagctgcagcagcgagccgtggagtacctcaccctcagctcagtggccagcaccgacgtcctggccacggtgctggaggagatgccgcccttccccgagcgcgagtcgtccatcctggccaagctgaaacgcaagaaggggccaggggccggcagcgccctggacgatggccggagggaccccagcagcaacgacatcaacgggggcatggagcccacccccagcactgtgtcgacgccctcgccctccgccgacctcctggggctgcgggcagcccctcccccggcagcacccccggcttctgcaggagcagggaaccttctggtggacgtcttcgatggcccggccgcccagcccagcctggggcccacccccgaggaggccttcctcagcccaggtcctgaggacatcggccctcccattccggaagccgatgagttgctgaataagtttgtgtgtaagaacaacggggtcctgttcgagaaccagctgctgcagatcggagtcaagtcagagttccgacagaacctgggccgcatgtatctcttctatggcaacaagacctcggtgcagttccagaatttctcacccactgtggttcacccgggagacctccagactcagctggctgtgcagaccaagcgcgtggcggcgcaggtggacggcggcgcgcaggtgcagcaggtgctcaatatcgagtgcctgcgggacttcctgacgcccccgctgctgtccgtgcgcttccggtacggtggcgccccccaggccctcaccctgaagctcccagtgaccatcaacaagttcttccagcccaccgagatggcggcccaggatttcttccagcgctggaagcagctgagcctccctcaacaggaggcgcagaaaatcttcaaagccaaccaccccatggacgcagaagttactaaggccaagcttctggggtttggctctgctctcctggacaatgtggaccccaaccctgagaacttcgtgggggcggggatcatccagactaaagccctgcaggtgggctgtctgcttcggctggagcccaatgcccaggcccagatgtaccggctgaccctgcgcaccagcaaggagcccgtctcccgtcacctgtgtgagctgctggcacagcagttctgagccctggactctgccccgggggatgtggccggcactgggcagccccttggactgaggcagttttggtggatgggggacctccactggtgacagagaagacaccagggtttgggggatgcctgggactttcctccggccttttgtatttttatttttgttcatctgctgctgtttacattctggggggttagggggagtccccctccctccctttcccccccaagcacagaggggagaggggccagggaagtggatgtctcctcccctcccaccccaccctgttgtagcccctcctaccccctccccatccaggggctgtgtattattgtgagcgaataaacagagagacgctaa

SEQ ID NO: 294 - protein, 955 aa, Homo sapiens
MPAVSKGDGMRGLAVFISDIRNCKSKEAEIKRINKELANIRSKFKGDKALDGYSKKKYVCKLLFIFLLGHDIDFGHMEAVNLLSSNKYTEKQIGYLFISVLVNSNSELIRLINNAIKNDLASRNPTFMCLALHCIANVGSREMGEAFAADIPRILVAGDSMDSVKQSAALCLLRLYKASPDLVPMGEWTARVVHLLNDQHMGVVTAAVSLITCLCKKNPDDFKTCVSLAVSRLSRIVSSASTDLQDYTYYFVPAPWLSVKLLRLLQCYPPPEDAAVKGRLVECLETVLNKAQEPPKSKKVQHSNAKNAILFETISLIIHYDSEPNLLVRACNQLGQFLQHRETNLRYLALESMCTLASSEFSHEAVKTHIDTVINALKTERDVSVRQRAADLLYAMCDRSNAKQIVSEMLRYLETADYAIREEIVLKVAILAEKYAVDYSWYVDTILNLIRIAGDYVSEEVWYRVLQIVTNRDDVQGYAAKTVFEALQAPACHENMVKVGGYILGEFGNLIAGDPRSSPPVQFSLLHSKFHLCSVATRALLLSTYIKFINLFPETKATIQGVLRAGSQLRNADVELQQRAVEYLTLSSVASTDVLATVLEEMPPFPERESSILAKLKRKKGPGAGSALDDGRRDPSSNDINGGMEPTPSTVSTPSPSADLLGLRAAPPPAAPPASAGAGNLLVDVFDGPAAQPSLGPTPEEAFLSPGPEDIGPPIPEADELLNKFVCKNNGVLFENQLLQIGVKSEFRQNLGRMYLFYGNKTSVQFQNFSPTVVHPGDLQTQLAVQTKRVAAQVDGGAQVQQVLNIECLRDFLTPPLLSVRFRYGGAPQALTLKLPVTINKFFQPTEMAAQDFFQRWKQLSLPQQEAQKIFKANHPMDAEVTKAKLLGFGSALLDNVDPNPENFVGAGIIQTKALQVGCLLRLEPNAQAQMYRLTLRTSKEPVSRHLCELLAQQF

SEQ ID NO: 295 - DNA, 3421 bp, Homo sapiens
gccgacggacggcgggcggcggcggcggtggcggcgctggagtcggcgcgggtgctggcgccatggaggccgagcggggtcccgagcgccggcctgcggagcgtagcagcccgggccagacgccggaggagggcgcgcaggccttggccgagttcgcggcgctgcacggcccggcgctgcgcgcttcgggggtccccgaacgttactggggccgcctcctgcacaagctggagcacgaggttttcgacgctggggaagtgtttgggatcatgcaagtggaggaggtagaagaggaggaggacgaggcagcccgggaggtgcggaagcagcagcccaacccggggaacgagctgtgctacaaggtcatcgtgaccagggagagcgggctccaggcagcccaccccaacagcatcttcctcatcgaccacgcctggacgtgccgtgtggagcacgcgcgccagcagctgcagcaggtgcccgggctgctgcaccgcatggccaacctgatgggcattgagttccacggtgagctgcccagtacagaggctgtggccctggtgctggaggagatgtggaagttcaaccagacctaccagctggcccatgggacagctgaggagaagatgccggtgtggtatatcatggacgagttcggttcgcggatccagcacgcggacgtgcccagcttcgccacggcacccttcttctacatgccgcagcaggtggcctacacgctgctgtggcccctgagggacctggacactggcgaggaggtgacccgagactttgcctacggagagacggaccccctgatccggaagtgcatgctgctgccctgggcccccaccgacatgctggacctcagctcttgcacacccgagccgcccgccgagcactaccaggccattctggaggaaaacaaggagaagctgccacttgacatcaaccccgtggtgcacccccacggccacatcttcaaggtctacacggacgtgcagcaggtggccagcagcctcacccacccgcgcttcaccctcacccagagtgaggcggacgccgacatcctcttcaacttctcacacttcaaggactacaggaaactcagccaggagaggccaggcgtgctgctgaaccagttcccctgcgagaacctgctgactgtcaaggactgcctggcctccatcgcgcgccgggcaggtggccccgagggcccaccctggctgccccgaaccttcaacctgcgcactgagctgccccagtttgtcagctacttccagcagcgggaaaggtggggcgaggacaaccactggatctgcaagccctggaacctggcgcgcagcctggacacccacgtcaccaagagcctgcacagcatcatccggcaccgagagagcacccccaaggttgtgtccaagtacatcgaaagtcccgtgttgttccttcgagaagacgtgggaaaggtcaagttcgacatccgctacatcgtgctgctgcggtcagtgaggcccctacggttgttcgtgtatgatgtgttctggctgcggttctccaaccgggcctttgcactcaacgacctggatgactacgagaagcacttcacggtcatgaactatgacccggatgtggtgctgaagcaggtgcactgtgaagagttcatccccgagtttgagaagcaatacccagaatttccctggacggacgtccaggctgagatcttccgggccttcacggagctgttccaggtggcctgtgccaagccaccacccctgggcctctgcgactacccctcatcccgggccatgtatgccgtcgacctcatgctgaagtgggacaacggcccagatggaaggcgggtgatgcagccgcagatcctggaggtgaacttcaaccccgactgtgagcgagcctgcaggtaccaccccaccttcttcaacgacgtcttcagcaccttgtttctggaccagcccggtggctgccacgttacctgccttgtctaggcactcgctgtccccaaaacctgtgcttggggcaggattccaacctcagttctctgagctgcttctgcaaaggcccccatgtccctccccacaccggccctgggcatagcctcagccccaggcctctgtcctgccgagccatcctcccggcgccacactccgggagcacagcatcctcctctcacctgtgggtcagagcaggacagtgatggtgtccccagggctgagcaccaccccacgccctgccctcacccctcaccaccatctgtgcactgatgagtctccagtttagccaagggctttgttcctggcatggagaatttgttcctggctgctgtgtttccagggggtgctgggggaagggttccgtggagcgagacaaggtgtcctcgggagcagggttccaccgggaagcgtttgggagccctgtatcacacggggcaggcgggtttctcttccggggtctctgctcttatgcatcaggacgaccccgggacggctgtggggccccacactgcacccacagggctctatgcgacaggggcccaggaacagcctgaggccaccacccagcaagcccgccttatcacccattccagctcacccagaaccttcaccagcaaacctcctgctgaggtcctggcaggaggccaccgtcttgttaccgtttccttttcgtttgctgagggtcacagaccccaacagggaaatcagtatctgtcttcccagtggttgccctgctcgccgggcactccacggggtcccgcccttgtgtgagatgggccaggatccttcggcaaggggcgcctggggctggggctgattgtgggcggtggagcgccagacagaaaaggattccaatgagaacttcaggttaaagtcagatgccacctaccagggtctacagtcaaaatgttggctttttcttattttttaatgtatgggagaaaaatgtaaaattccagttcttttctaattgtgtttctgaaattaggagtcagctgccagcgtttttgtgtggctgcagtgtgcctgggcccagctcacgggcagtgggtggacctaactgcccaggcaggcgagagctacttccagagccttccagtgcatgggagggcagggctaggtgtagcggtgtctcctctttgaaattaagaactatctttcttgtagcaaagctgcacctgatgatgctgcctctcctctctgtgttgtctgggcccttgtttacaagcacgcgttacccttcctgaggggagccatgctctagcccctggagggcctgttgcaggggcagggcgggcccgtcgcctttggcagctcctggagagctgtggacatgcagtccccctcagttcgtgctgcaataaaggccatcttctcttaaaaaaaaaaaaaaaaaaaaaaaaaaaaaaaaaaaaaaa

SEQ ID NO: 296 - protein, 644 aa, Homo sapiens
MEAERGPERRPAERSSPGQTPEEGAQALAEFAALHGPALRASGVPERYWGRLLHKLEHEVFDAGEVFGIMQVEEVEEEEDEAAREVRKQQPNPGNELCYKVIVTRESGLQAAHPNSIFLIDHAWTCRVEHARQQLQQVPGLLHRMANLMGIEFHGELPSTEAVALVLEEMWKFNQTYQLAHGTAEEKMPVWYIMDEFGSRIQHADVPSFATAPFFYMPQQVAYTLLWPLRDLDTGEEVTRDFAYGETDPLIRKCMLLPWAPTDMLDLSSCTPEPPAEHYQAILEENKEKLPLDINPVVHPHGHIFKVYTDVQQVASSLTHPRFTLTQSEADADILFNFSHFKDYRKLSQERPGVLLNQFPCENLLTVKDCLASIARRAGGPEGPPWLPRTFNLRTELPQFVSYFQQRERWGEDNHWICKPWNLARSLDTHVTKSLHSIIRHRESTPKVVSKYIESPVLFLREDVGKVKFDIRYIVLLRSVRPLRLFVYDVFWLRFSNRAFALNDLDDYEKHFTVMNYDPDVVLKQVHCEEFIPEFEKQYPEFPWTDVQAEIFRAFTELFQVACAKPPPLGLCDYPSSRAMYAVDLMLKWDNGPDGRRVMQPQILEVNFNPDCERACRYHPTFFNDVFSTLFLDQPGGCHVTCLV

SEQ ID NO: 297 - DNA, 3372 bp, Homo sapiens
gggtggagcgcggggagccaggcgaggggccgcgacgacgggactccattagccgctccggccacaggcagcgcttcgccagccgaggaaccggacgcggacaccgccgccccgcgagcctccagcccctcgcctgttgccgcgcgagtcccgggcccggagcgctaggagcgcgcggaaggagccatggctctggacgggataaggatgccagatggctgctacgcggacgggacgtgggaactgagtgtccatgtgacggacctgaaccgcgatgtcaccctgagagtgaccggcgaggtgcacattggaggcgtgatgcttaagctggtggagaaactcgatgtaaaaaaagattggtctgaccatgctctctggtgggaaaagaagagaacttggcttctgaagacacattggaccttagataagtatggtattcaggcagatgctaagcttcagttcacccctcagcacaaactgctccgcctgcagcttcccaacatgaagtatgtgaaggtgaaagtgaatttctctgatagagtcttcaaagctgtttctgacatctgtaagacttttaatatcagacaccccgaagaactttctctcttaaagaaacccagagatccaacaaagaaaaaaaagaagaagctagatgaccagtctgaagatgaggcacttgaattagaggggcctcttatcactcctggatcaggaagtatatattcaagcccaggactgtatagtaaaacaatgacccccacttatgatgctcatgatggaagccccttgtcaccaacttctgcttggtttggtgacagtgctttgtcagaaggcaatcctggtatacttgctgtcagtcaaccaatcacgtcaccagaaatcttggcaaaaatgttcaagcctcaagctcttcttgataaagcaaaaatcaaccaaggatggcttgattcctcaagatctctcatggaacaagatgtgaaggaaaatgaggccttgctgctccgattcaagtattacagcttttttgatttgaatccaaagtatgatgcaatcagaatcaatcagctttacgagcaggccaaatgggccattctcctggaagagattgaatgcacagaagaagaaatgatgatgtttgcagccctgcagtatcatatcaataagctgtcaatcatgacatcagagaatcatttgaacaacagtgacaaagaagttgatgaagttgatgctgccctttcagacctggagattactctggaagggggtaaaacgtcaacaattttgggtgacattacttccattcctgaacttgctgactacattaaagttttcaagccaaaaaagctgactctgaaaggttacaaacaatattggtgcaccttcaaagacacatccatttcttgttataagagcaaagaagaatccagtggcacaccagctcatcagatgaacctcaggggatgtgaagttaccccagatgtaaacatttcaggccaaaaatttaacattaaactcctgattccagttgcagaaggcatgaatgaaatctggcttcgttgtgacaatgaaaaacagtatgcacactggatggcagcctgcagattagcctccaaaggcaagaccatggcggacagttcttacaacttagaagttcagaatattctttcctttctgaagatgcagcatttaaacccagatcctcagttaataccagagcagatcacgactgatataactcctgaatgtttggtgtctccccgctatctaaaaaagtataagaacaagcagccaggctatataagagatttgataacagcgagaatcttggaggcccatcagaatgtagctcagatgagtctaattgaagccaagatgagatttattcaagcttggcagtcactacctgaatttggcatcactcacttcattgcaaggttccaagggggcaaaaaagaagaacttattggaattgcatacaacagactgattcggatggatgccagcactggagatgcaattaaaacatggcgtttcagcaacatgaaacagtggaatgtcaactgggaaatcaaaatggtcaccgtagagtttgcagatgaagtacgattgtccttcatttgtactgaagtagattgcaaagtggttcatgaattcattggtggctacatatttctctcaacacgtgcaaaagaccaaaacgagagtttagatgaagagatgttctacaaacttaccagtggttgggtgtgaataggaatactgtttaatgaaactccacggccataacaatatttaactttaaaagctgtttgttatatgctgcttaataaagtaagcttgaaatttatcattttatcatgaaaacttctttgccttaccagaccagttaatatgtgcactaaacaagcacgactattaatctatcatgttatgatataataaacttgaatttgtcacacattccttagggccatgaattgaaaactgaaatagtgggcaaatcaggaacaaaccatcactgatttactgatttaagctagccaaactgtaagaaacaagccatctattttaaagctatccagggcttaacctatatgaactctatttatcatgtctaatgcatgtgatttaatgtatgtttaatttgatatcatgttttaaaatatcctacttctggtagccatttaattcctccccctacccccaaataaatcaggcatgcaggaggcctgatatttagtaatgtcattgtgtttgaccttgaaggaaaatgctattagtccgtcgtgcttgatttgtttttgtccttgaataagcatgttatgtatattgtctcgtgtttttatttttacaccatattgtattacacttttagtattcaccagcataatcactgtctgcctaaaatatgcaactctttgcattacaatatgaagtaaagttctatgaagtatgcattttgtgtaactaatgtaaaaacacaaattttataaaattgtacagttttttaaaaactactcacaactagcagatggcttaaatgtagcaatctctgcgttaattaaatgcctttaagagatataattaacgtgcagttttaatatctactaaattaagaatgacttcattatgatcatgatttgccacaatgtccttaactctaatgcctggactggccatgttctagtctgttgcgctgttacaatctgtattggtgctagtcagaaaattcctagctcacatagcccaaaagggtgcgagggagaggtggattaccagtattgttcaataatccatggttcaaagactgtataaatgcattttattttaaataaaagcaaaacttttatttaataaaaaaaaaaaaaaaaa

SEQ ID NO: 298 - protein, 687 aa, Homo sapiens
MALDGIRMPDGCYADGTWELSVHVTDLNRDVTLRVTGEVHIGGVMLKLVEKLDVKKDWSDHALWWEKKRTWLLKTHWTLDKYGIQADAKLQFTPQHKLLRLQLPNMKYVKVKVNFSDRVFKAVSDICKTFNIRHPEELSLLKKPRDPTKKKKKKLDDQSEDEALELEGPLITPGSGSIYSSPGLYSKTMTPTYDAHDGSPLSPTSAWFGDSALSEGNPGILAVSQPITSPEILAKMFKPQALLDKAKINQGWLDSSRSLMEQDVKENEALLLRFKYYSFFDLNPKYDAIRINQLYEQAKWAILLEEIECTEEEMMMFAALQYHINKLSIMTSENHLNNSDKEVDEVDAALSDLEITLEGGKTSTILGDITSIPELADYIKVFKPKKLTLKGYKQYWCTFKDTSISCYKSKEESSGTPAHQMNLRGCEVTPDVNISGQKFNIKLLIPVAEGMNEIWLRCDNEKQYAHWMAACRLASKGKTMADSSYNLEVQNILSFLKMQHLNPDPQLIPEQITTDITPECLVSPRYLKKYKNKQPGYIRDLITARILEAHQNVAQMSLIEAKMRFIQAWQSLPEFGITHFIARFQGGKKEELIGIAYNRLIRMDASTGDAIKTWRFSNMKQWNVNWEIKMVTVEFADEVRLSFICTEVDCKVVHEFIGGYIFLSTRAKDQNESLDEEMFYKLTSGWV

SEQ ID NO: 299 - DNA, 3002 bp, Homo sapiens
agaggggtggggtggaggagggaggcgggcgcgccggattggcctctgcgcgccacgtgtccggctcggagcccacggctgtcctcccggtccgccccgcgctgcggttgctgctgggctaacgggctccgatccagcgagcgctgcgtcctcgagtccctgcgcccgtgcgtccgtctgcgacccgaggcctccgctgcgcgtggattctgctgcgaaccggagaccatggccaaaccagcacagggtgccaagtaccggggctccatccatgacttcccaggctttgaccccaaccaggatgccgaggctctgtacactgccatgaagggctttggcagtgacaaggaggccatactggacataatcacctcacggagcaacaggcagaggcaggaggtctgccagagctacaagtccctctacggcaaggacctcattgctgatttaaagtatgaattgacgggcaagtttgaacggttgattgtgggcctgatgaggccacctgcctattgtgatgccaaagaaattaaagatgccatctcgggcattggcactgatgagaagtgcctcattgagatcttggcttcccggaccaatgagcagatgcaccagctggtggcagcatacaaagatgcctacgagcgggacctggaggctgacatcatcggcgacacctctggccacttccagaagatgcttgtggtcctgctccagggaaccagggaggaggatgacgtagtgagcgaggacctggtacaacaggatgtccaggacctatacgaggcaggggaactgaaatggggaacagatgaagcccagttcatttacatcttgggaaatcgcagcaagcagcatcttcggttggtgttcgatgagtatctgaagaccacagggaagccgattgaagccagcatccgaggggagctgtctggggactttgagaagctaatgctggccgtagtgaagtgtatccggagcaccccggaatattttgctgaaaggctcttcaaggctatgaagggcctggggactcgggacaacaccctgatccgcatcatggtctcccgtagtgagttggacatgctcgacattcgggagatcttccggaccaagtatgagaagtccctctacagcatgatcaagaatgacacctctggcgagtacaagaagactctgctgaagctgtctgggggagatgatgatgctgctggccagttcttcccggaggcagcgcaggtggcctatcagatgtgggaacttagtgcagtggcccgagtagagctgaagggaactgtgcgcccagccaatgacttcaaccctgacgcagatgccaaagcgctgcggaaagccatgaagggactcgggactgacgaagacacaatcatcgatatcatcacgcaccgcagcaatgtccagcggcagcagatccggcagaccttcaagtctcactttggccgggacttaatgactgacctgaagtctgagatctctggagacctggcaaggctgattctggggctcatgatgccaccggcccattacgatgccaagcagttgaagaaggccatggagggagccggcacagatgaaaaggctcttattgaaatcctggccactcggaccaatgctgaaatccgggccatcaatgaggcctataaggaggactatcacaagtccctggaggatgctctgagctcagacacatctggccacttcaggaggatcctcatttctctggccacggggcatcgtgaggagggaggagaaaacctggaccaggcacgggaagatgcccaggtggctgctgagatcttggaaatagcagacacacctagtggagacaaaacttccttggagacacgtttcatgacgatcctgtgtacccggagctatccgcacctccggagagtcttccaggagttcatcaagatgaccaactatgacgtggagcacaccatcaagaaggagatgtctggggatgtcagggatgcatttgtggccattgttcaaagtgtcaagaacaagcctctcttctttgccgacaaactttacaaatccatgaagggtgctggcacagatgagaagactctgaccaggatcatggtatcccgcagtgagattgacctgctcaacatccggagggaattcattgagaaatatgacaagtctctccaccaagccattgagggtgacacctccggagacttcctgaaggccttgctggctctctgtggtggtgaggactagggccacagctttggcgggcacttctgccaagaaatggttatcagcaccagccgccatggccaagcctgattgttccagctccagagactaaggaaggggcaggggtggggggaggggttgggttgggctcttatcttcagtggagcttaggaaacgctcccactcccacgggccatcgagggcccagcacggctgagcggctgaaaaaccgtagccatagatcctgtccacctccactcccctctgaccctcaggctttcccagcttcctccccttgctacagcctctgccctggtttgggctatgtcagatccaaaaacatcctgaacctctgtctgtaaaatgagtagtgtctgtactttgaatgagggggttggtggcaggggccagttgaatgtgctgggcggggtggtgggaaggatagtaaatgtgctggggcaaactgacaaatcttcccatccatttcaccacccatctccatccaggccgcgctagagtactggaccaggaatttggatgcctgggttcaaatctgcatctgccatgcacttgtttctgaccttaggccagcccctttccctccctgagtctctattttcttatctacaatgagacagttggacaaaaaaatcttggcttcccttctaacattaacttcctaaagtatgcctccgattcattcccttgacactttttatttctaaggaagaaataaaaagagatacacaaacacataaacacaaaaaaaaaaa

SEQ ID NO: 300 - protein, 673 aa, Homo sapiens
MAKPAQGAKYRGSIHDFPGFDPNQDAEALYTAMKGFGSDKEAILDIITSRSNRQRQEVCQSYKSLYGKDLIADLKYELTGKFERLIVGLMRPPAYCDAKEIKDAISGIGTDEKCLIEILASRTNEQMHQLVAAYKDAYERDLEADIIGDTSGHFQKMLVVLLQGTREEDDVVSEDLVQQDVQDLYEAGELKWGTDEAQFIYILGNRSKQHLRLVFDEYLKTTGKPIEASIRGELSGDFEKLMLAVVKCIRSTPEYFAERLFKAMKGLGTRDNTLIRIMVSRSELDMLDIREIFRTKYEKSLYSMIKNDTSGEYKKTLLKLSGGDDDAAGQFFPEAAQVAYQMWELSAVARVELKGTVRPANDFNPDADAKALRKAMKGLGTDEDTIIDIITHRSNVQRQQIRQTFKSHFGRDLMTDLKSEISGDLARLILGLMMPPAHYDAKQLKKAMEGAGTDEKALIEILATRTNAEIRAINEAYKEDYHKSLEDALSSDTSGHFRRILISLATGHREEGGENLDQAREDAQVAAEILEIADTPSGDKTSLETRFMTILCTRSYPHLRRVFQEFIKMTNYDVEHTIKKEMSGDVRDAFVAIVQSVKNKPLFFADKLYKSMKGAGTDEKTLTRIMVSRSEIDLLNIRREFIEKYDKSLHQAIEGDTSGDFLKALLALCGGED

SEQ ID NO: 301 - DNA, 1332 bp, Homo sapiens
aattggaggagttgttgttaggccgtcccggagacccggtcgggagggaggaaggtggcaagatggtgttggaaagcactatggtgtgtgtggacaacagtgagtatatgcggaatggagacttcttacccaccaggctgcaggcccagcaggatgctgtcaacatagtttgtcattcaaagacccgcagcaaccctgagaacaacgtgggccttatcacactggctaatgactgtgaagtgctgaccacactcaccccagacactggccgtatcctgtccaagctacatactgtccaacccaagggcaagatcaccttctgcacgggcatccgcgtggcccatctggctctgaagcaccgacaaggcaagaatcacaagatgcgcatcattgcctttgtgggaagcccagtggaggacaatgagaaggatctggtgaaactggctaaacgcctcaagaaggagaaagtaaatgttgacattatcaattttggggaagaggaggtgaacacagaaaagctgacagcctttgtaaacacgttgaatggcaaagatggaaccggttctcatctggtgacagtgcctcctgggcccagtttggctgatgctctcatcagttctccgattttggctggtgaaggtggtgccatgctgggtcttggtgccagtgactttgaatttggagtagatcccagtgctgatcctgagctggccttggcccttcgtgtatctatggaagagcagcggcagcggcaggaggaggaggcccggcgggcagctgcagcttctgctgctgaggccgggattgctacgactgggactgaagactcagacgatgccctgctgaagatgaccatcagccagcaagagtttggccgcactgggcttcctgacctaagcagtatgactgaggaagagcagattgcttatgccatgcagatgtccctgcagggagcagagtttggccaggcggaatcagcagacattgatgccagctcagctatggacacatctgagccagccaaggaggaggatgattacgacgtgatgcaggaccccgagttccttcagagtgtcctagagaacctcccaggtgtggatcccaacaatgaagccattcgaaatgctatgggctccctggcctcccaggccaccaaggacggcaagaaggacaagaaggaggaagacaagaagtgagactggagggaaagggtagctgagtctgcttaggggactgcatgggaagcacggaatatagggttagatgtgtgttatctgtaaccattacagcctaaataaagcttggcaactttttttccttttttgcttcaaa

SEQ ID NO: 302 - protein, 377 aa, Homo sapiens
MVLESTMVCVDNSEYMRNGDFLPTRLQAQQDAVNIVCHSKTRSNPENNVGLITLANDCEVLTTLTPDTGRILSKLHTVQPKGKITFCTGIRVAHLALKHRQGKNHKMRIIAFVGSPVEDNEKDLVKLAKRLKKEKVNVDIINFGEEEVNTEKLTAFVNTLNGKDGTGSHLVTVPPGPSLADALISSPILAGEGGAMLGLGASDFEFGVDPSADPELALALRVSMEEQRQRQEEEARRAAAASAAEAGIATTGTEDSDDALLKMTISQQEFGRTGLPDLSSMTEEEQIAYAMQMSLQGAEFGQAESADIDASSAMDTSEPAKEEDDYDVMQDPEFLQSVLENLPGVDPNNEAIRNAMGSLASQATKDGKKDKKEEDKK

SEQ ID NO: 303 - DNA, 1850 bp, Homo sapiens
cgcgctcgcagctcgcaggcgccgcgtagccgtcgccaccgccgccagcccgtgcgccctcggcgcgtacccgccgcgctcccatccccgccgccggccaggggcgcgctcggccgccccggacagtgtcccgctgcggctccgcggcgatggccaccaagatcgacaaagaggcttgccgggcggcgtacaacctggtgcgcgacgacggctcggccgtcatctgggtgacttttaaatatgacggctccaccatcgtccccggcgagcagggagcggagtaccagcacttcatccagcagtgcacagatgacgtccggttgtttgccttcgtgcgcttcaccaccggggatgccatgagcaagaggtccaagtttgccctcatcacgtggatcggtgagaacgtcagcgggctgcagcgcgccaaaaccgggacggacaagaccctggtgaaggaggtcgtacagaatttcgctaaggagtttgtgatcagtgatcggaaggagctggaggaagatttcatcaagagcgagctgaagaaggcggggggagccaattacgacgcccagacggagtaaccccagcccccgccacaccaccccttgccaaagtcatctgcctgctccccgggggagaggaccgccggcctcagctactagcccaccagcccaccagggagaaaagaagccatgagaggcagcgcccgccaccctgtgtccacagcccccaccttcccgcttcccttagaaccctgccgtgtcctatctcatgacgctcatggaacctctttctttgatcttctttttcttttctccccctcttttttgttctaaagaaaagtcattttgatgcaaggtcctgcctgccatcagatccgaggtgcctcctgcagtgaccccttttcctggcatttctcttccacgcgacgaggtctgcctagtgagatctgcatgacctcacgttgctttccagagcccgggcctattttgccatctcagttttcctggaccctgcttcctgtgtaccactgaggggcagctgggccaggagctgtgcccggtgcctgcagccttcataagcacacacgtccattccctactaaggcccagacctcctggtatctgccccgggctccctcatcccacctccatccggagttgcctaagatgcatgtccagcataggcaggattgctcggtggtgagaaggttaggtccggctcagactgaataagaagagataaaatttgccttaaaacttacctggcagtggctttgctgcacggtctgaaaccacctgttcccaccctcttgaccgaaatttccttgtgacacagagaagggcaaaggtctgagcccagagttgacggagggagtatttcagggttcacttcaggggctcccaaagcgacaagatcgttagggagagaggcccagggtggggactgggaatttaaggagagctgggaacggatcccttaggttcaggaagcttctgtgtaagctgcgaggatggcttgggccgaagggttgctctgcccgccgcgctagctgtgagctgagcaaagccctgggctcacagcaccccaaaagcctgtggcttcagtcctgcgtctgcaccacacattcaaaaggatcgttttgttttgtttttaaagaaaggtgagattggcttggttcttcatgagcacatttgatatagctctttttctgtttttccttgctcatttcgttttggggaagaaatctgtactgtattgggattgtaaagaacatctctgcactcagacagtttacagaaataaatgttttttttgtttttcagaaaaaaaaaaaaaaaaaaaaaaaaaaa

SEQ ID NO: 304 - protein, 142 aa, Homo sapiens
MATKIDKEACRAAYNLVRDDGSAVIWVTFKYDGSTIVPGEQGAEYQHFIQQCTDDVRLFAFVRFTTGDAMSKRSKFALITWIGENVSGLQRAKTGTDKTLVKEVVQNFAKEFVISDRKELEEDFIKSELKKAGGANYDAQTE

SEQ ID NO: 305 - DNA, 3214 bp, Homo sapiens
gggtgggaggagccagcggccggggaggttctagtctgttctgtcttgcggcagccgcccccttctgcgcggtcacgccgagccagcgcctgggcctggaaccgggccgtagcccccccagtttcgcccaccacctccctaccatggacccccgcaaagtgaacgagcttcgggcctttgtgaaaatgtgtaagcaggatccgagcgttctgcacaccgaggaaatgcgcttcctgagggagtgggtggagagcatgggtggtaaagtaccacctgctactcagaaagctaaatcagaagaaaataccaaggaagaaaaacctgatagtaagaaggtggaggaagacttaaaggcagacgaaccatcaagtgaggaaagtgatctagaaattgataaagaaggtgtgattgaaccagacactgatgctcctcaagaaatgggagatgaaaatgcggagataacggaggagatgatggatcaggcaaatgataaaaaagtggctgctattgaagccctaaatgatggtgaactccagaaagccattgacttattcacagatgccatcaagctgaatcctcgcttggccattttgtatgccaagagggccagtgtcttcgtcaaattacagaagccaaatgctgccatccgagactgtgacagagccattgaaataaatcctgattcagctcagccttacaagtggcgggggaaagcacacagacttctaggccactgggaagaagcagcccatgatcttgcccttgcctgtaaattggattatgatgaagatgctagtgcaatgctgaaagaagttcaacctagggcacagaaaattgcagaacatcggagaaagtatgagcgaaaacgtgaagagcgagagatcaaagaaagaatagaacgagttaagaaggctcgagaagagcatgagagagcccagagggaggaagaagccagacgacagtcaggagctcagtatggctcttttccaggtggctttcctgggggaatgcctggtaattttcccggaggaatgcctggaatgggagggggcatgcctggaatggctggaatgcctggactcaatgaaattcttagtgatccagaggttcttgcagccatgcaggatccagaagttatggtggctttccaggatgtggctcagaacccagcaaatatgtcaaaataccagagcaacccaaaggttatgaatctcatcagtaaattgtcagccaaatttggaggtcaagcgtaatgtccttctgataaataaagcccttgctgaaggaaaagcaacctagatcaccttatggatgtcgcaataatacaaaccagtgtacctctgaccttctcatcaagagagctggggtgctttgaagataatccctacccctctcccccaaatgcagctgaagcattttacagtggtttgccattagggtattcattcagataatgttttcctactaggaattacaaactttaaacactttttaaatcttcaaaatatttaaaacaaatttaaagggcctgttaattcttatatttttctttactaatcattttggatttttttctttgaattattggcagggaatatacttatgtatggaagattactgctctgagtgaaataaaagttattagtgcgaggcaaacataactcatttgaggataaagtttgtgttggatatgtggttcctgatgcattttgacttgtctttttaaatgctttatctttttctttaaagatttatttcaataaaactaattgggaccacccgtatttcagtaggacctgggtagggattggaagtacttggcagggcagcagcaatcttgctgtgtttgatataacatgcatccttgggcaggttgcccttaaatcttacactgtggtgaagggatgttttttttgtaatgctgcagtagagttggagtacttagttctcttgttgtccagtatatctaataagtgtttttcatattatttccacgtaagggaaataaggtagtacttttctttttatatttctatgcttaaaattctctttcctagtcaaaaattgcccaaatctgtgtttgctttctgcttgctacatttgtctcccttacttttcttgagctaaagacaggctttttccaccggcatcatcactgctatcatcattaacagcgtaattatacaagcatatttaatgctgagtttaatttaatatgtaatacatatggtaattgtagggtaatacccacaacaactgtagtttcttacttggccaagagaatgcttatttaagtgttagacttccattctggcaaaatcttgccttatcagaagacattggaaagagggattccctttggtgtttggtcttctacttagaaaaacctattgcagttagtttatcttgtagtattcatctttgtattctgaagataaggtttgaattaaattgatacacacagaggggaaccgattttttttatccaatgtgaattataaatgagataatccacagttattcattgtggagttgttgagactatgaaagactcattgtctttgtattcagctcttaaatagtgtaactatatccccacctctgcttgctttctttccctcccctccaatgataaagaaaatgataaattttctgttgtgcattcaattcttattttaaataagactaagtataggcattgtacctgacattgctacgtttctaccagtgtttcaatttaaagtgctagtgtttaaaaacattttcaagggataaggccttctgtactttgcttatttgaagaatcagtggtaggagcagtgaagtaaattctatggagtacatttctaaaataccacatttctgaaatcataaataagtttattcaggttctaaccctttgctgtacacaagcagacagaaatgcatctgttacataaatgagaaaaagctattatgctgatggagcatgctttttaaatcctttaaaaacactcaccatataaacttgcatttgagcttgtgtgttcttttgttaatgtgtagagttctcctttctcgaaattgccagtgtgtacttggcttaactcaagaacagtttcttctggattccttatttgatttatttaacctaattatattctaatattgcaaatattaccataagtgggtaaaagtaaaattcctcttctgaaaaaaaaaaaaaaaaaaaaaa

SEQ ID NO: 306 - protein, 369 aa, Homo sapiens
MDPRKVNELRAFVKMCKQDPSVLHTEEMRFLREWVESMGGKVPPATQKAKSEENTKEEKPDSKKVEEDLKADEPSSEESDLEIDKEGVIEPDTDAPQEMGDENAEITEEMMDQANDKKVAAIEALNDGELQKAIDLFTDAIKLNPRLAILYAKRASVFVKLQKPNAAIRDCDRAIEINPDSAQPYKWRGKAHRLLGHWEEAAHDLALACKLDYDEDASAMLKEVQPRAQKIAEHRRKYERKREEREIKERIERVKKAREEHERAQREEEARRQSGAQYGSFPGGFPGGMPGNFPGGMPGMGGGMPGMAGMPGLNEILSDPEVLAAMQDPEVMVAFQDVAQNPANMSKYQSNPKVMNLISKLSAKFGGQA

SEQ ID NO: 307 - DNA, 2008 bp, Homo sapiens
agaaggtttcatttccgggtggcgcgggcgccattttgtgaggagcgatataaacgggcgcagaggccggctgcccgcccagttgttactcaggtgcgctagcctgcggagcccgtccgtgctgttctgcggcaaggcctttcccagtgtccccacgcggaaggcaactgcctgagaggcgcggcgtcgcaccgcccagagctgaggaagccggcgccagttcgcggggctccgggccgccactcagagctatgagctacggccgcccccctcccgatgtggagggtatgacctccctcaaggtggacaacctgacctaccgcacctcgcccgacacgctgaggcgcgtcttcgagaagtacgggcgcgtcggcgacgtgtacatcccgcgggaccgctacaccaaggagtcccgcggcttcgccttcgttcgctttcacgacaagcgcgacgctgaggacgctatggatgccatggacggggccgtgctggacggccgcgagctgcgggtgcaaatggcgcgctacggccgccccccggactcacaccacagccgccggggaccgccaccccgcaggtacgggggcggtggctacggacgccggagccgcagccctaggcggcgtcgccgcagccgatcccggagtcggagccgttccaggtctcgcagccgatctcgctacagccgctcgaagtctcggtcccgcactcgttctcgatctcggtcgacctccaagtccagatccgcacgaaggtccaagtccaagtcctcgtcggtctccagatctcgttcgcggtccaggtcccggtctcggtccaggagtcctcccccagtgtccaagagggaatccaaatccaggtcgcgatcgaagagtccccccaagtctcctgaagaggaaggagcggtgtcctcttaagaaaatgatgtatcggcaagcagtgtaaacggaggacttggggaaaaaggaccacatagtccatcgaagaagagtccttggaacaagcaactggctattgaaaaggttattttgtaacatttgtctaactttttacttgtttaagctttgcctcagttggcaaacttcattttatgtgccattttgttgctgttattcaaatttcttgtaatttagtgaggtgaacgacttcagatttcattattggatttggatatttgaggtaaaatttcattttgttatatagtgctgactttttttgtttgaaattaaacagattggtaacctaatttgtggcctcctgacttttaaggaaaacgtgtgcagccattacacacagcctaaagctgtcaagagattgactcggcattgccttcattccttaaaattaaaaacctacaaaagttggtgtaaatttgtatatgttatttaccttcagatctaaatggtaatctgaacccaaatttgtataaagacttttcaggtgaaaagacttgattttttgaaaggattgtttatcaaacacaattctaatctcttctcttatgtatttttgtgcactaggcgcagttgtgtagcagttgagtaatgctggttagctgttaaggtggcgtgttgcagtgcagagtgcttggctgtttcctgttttctcccgattgctcctgtgtaaagatgccttgtcgtgcagaaacaaatggctgtccagtttattaaaatgcctgacaactgcacttccagtcacccgggccttgcatataaataacggagcatacagtgagcacatctagctgatgataaatacacctttttttccctcttccccctaaaaatggtaaatctgatcatatctacatgtatgaacttaacatggaaaatgttaaggaagcaaatggttgtaactttgtaagtacttataacatggtgtatctttttgcttatgaatattctgtattataaccattgtttctgtagtttaattaaaacattttcttggtgttagcttttctcagaaaaaaaaaaaaaaaaaaaaaaaaaaaaaaaaaaaaaaaaaa

SEQ ID NO: 308 - protein, 221 aa, Homo sapiens; identical to SEQ ID NO: 254

SEQ ID NO: 309 - DNA, 2304 bp, Homo sapiens
acaagggaccttatttaggttgcgcaggcgcccgctggccatttcgtcttagccacgcagaagtcgcgtgtctaggtgagtcgcggtgggtcctcgcttgcagttcagcgaccacgtttgtttcgacgccggaccgcgtaagagacgatgatgttgggcacggaaggtggagagggattcgtggtgaaggtccggggcttgccctggtcttgctcggccgatgaagtgcagaggtttttttctgactgcaaaattcaaaatggggctcaaggtattcgtttcatctacaccagagaaggcagaccaagtggcgaggcttttgttgaacttgaatcagaagatgaagtcaaattggccctgaaaaaagacagagaaactatgggacacagatatgttgaagtattcaagtcaaacaacgttgaaatggattgggtgttgaagcatactggtccaaatagtcctgacacggccaatgatggctttgtacggcttagaggacttccctttggatgtagcaaggaagaaattgttcagttcttctcagggttggaaatcgtgccaaatgggataacattgccggtggacttccaggggaggagtacgggggaggccttcgtgcagtttgcttcacaggaaatagctgaaaaggctctaaagaaacacaaggaaagaatagggcacaggtatattgaaatctttaagagcagtagagctgaagttagaactcattatgatccaccacgaaagcttatggccatgcagcggccaggtccttatgacagacctggggctggtagagggtataacagcattggcagaggagctggctttgagaggatgaggcgtggtgcttatggtggaggctatggaggctatgatgattacaatggctataatgatggctatggatttgggtcagatagatttggaagagacctcaattactgtttttcaggaatgtctgatcacagatacggggatggtggctctactttccagagcacaacaggacactgtgtacacatgcggggattaccttacagagctactgagaatgacatttataattttttttcaccgctcaaccctgtgagagtacacattgaaattggtcctgatggcagagtaactggtgaagcagatgtcgagttcgcaactcatgaagatgctgtggcagctatgtcaaaagacaaagcaaatatgcaacacagatatgtagaactcttcttgaattctacagcaggagcaagcggtggtgcttacgaacacagatatgtagaactcttcttgaattctacagcaggagcaagcggtggtgcttatggtagccaaatgatgggaggcatgggcttgtcaaaccagtccagctacgggggcccagccagccagcagctgagtgggggttacggaggcggctacggtggccagagcagcatgagtggatacgaccaagttttacaggaaaactccagtgattttcaatcaaacattgcataggtaaccaaggagcagtgaacagcagctactacagtagtggaagccgtgcatctatgggcgtgaacggaatgggagggttgtctagcatgtccagtatgagtggtggatggggaatgtaattgatcgatcctgatcactgactcttggtcaaccttttttttttttttttttttttctttaagaaaacttcagtttaacagtttctgcaatacaagcttgtgatttatgcttactctaagtggaaatcaggattgttatgaagacttaaggcccagtatttttgaatacaatactcatctaggatgtaacagtgaagctgagtaaactataactgttaaacttaagttccagcttttctcaagttagttataggatgtacttaagcagtaagcgtatttaggtaaaagcagttgaattatgttaaatgttgccctttgccacgttaaattgaacactgttttggatgcatgttgaaagacatgcttttatttttttgtaaaacaatataggagctgtgtctactattaaaagtgaaacattttggcatgtttgttaattctagtttcatttaataacctgtaaggcacgtaagtttaagctttttttttttttaagttaatgggaaaaatttgagacgcaataccaatacttaggattttggtcttggtgtttgtatgaaattctgaggccttgatttaaatctttcattgtattgtgatttccttttaggtatattgcgctaagtgaaacttgtcaaataaatcctccttttaaaaactgcaaaaaaaaaaaaaaaaaaaaaaaaaa

SEQ ID NO: 310 - protein, 449 aa, Homo sapiens
MMLGTEGGEGFVVKVRGLPWSCSADEVQRFFSDCKIQNGAQGIRFIYTREGRPSGEAFVELESEDEVKLALKKDRETMGHRYVEVFKSNNVEMDWVLKHTGPNSPDTANDGFVRLRGLPFGCSKEEIVQFFSGLEIVPNGITLPVDFQGRSTGEAFVQFASQEIAEKALKKHKERIGHRYIEIFKSSRAEVRTHYDPPRKLMAMQRPGPYDRPGAGRGYNSIGRGAGFERMRRGAYGGGYGGYDDYNGYNDGYGFGSDRFGRDLNYCFSGMSDHRYGDGGSTFQSTTGHCVHMRGLPYRATENDIYNFFSPLNPVRVHIEIGPDGRVTGEADVEFATHEDAVAAMSKDKANMQHRYVELFLNSTAGASGGAYEHRYVELFLNSTAGASGGAYGSQMMGGMGLSNQSSYGGPASQQLSGGYGGGYGGQSSMSGYDQVLQENSSDFQSNIA

SEQ ID NO: 311 - DNA, 7219 bp, Homo sapiens; identical to SEQ ID NO: 251

SEQ ID NO: 312 - protein, 1657 aa, Homo sapiens; identical to SEQ ID NO: 252

SEQ ID NO: 313 - DNA, 1180 bp, Homo sapiens
ggaggggcggggcggacgcagagccgcgtttagtctatcgctgcggttgcgagcgctgtagggagcctgtgctgtgccgcgcagttaggcagcagcagccgcggagcagtagccgccgtgggagggagccatgaagcattacgaggtggagattctggacgcaaagacaagggagaagctgtgtttcttggacaaggtggagccccacgccaccattgcggagatcaagaacctcttcactaagacccatccgcagtggtaccccgcccgccagtccctccgcctggaccccaagggcaagtccctgaaggatgaggatgttctgcagaagctgcccgtgggcaccacggccacactgtacttccgggacctgggggcccagatcagctgggtgacggtcttcctaacagagtacgcggggccccttttcatctacctgctcttctacttccgagtgcccttcatctatggccacaaatatgactttacgtccagtcggcatacagtggtgcacctcgcctgcatctgtcactcattccactacatcaagcgcctgctggagacgctcttcgtgcaccgcttctcccatggcactatgcctttgcgcaacatcttcaagaactgcacctactactggggcttcgccgcgtggatggcctattacatcaatcaccctctctacactccccctacctacggagctcagcaggtgaaactggcgctcgccatctttgtgatctgccagctcggcaacttctccatccacatggccctgcgggacctgcggcccgctgggtccaagacgcggaagatcccataccccaccaagaaccccttcacgtggctcttcctgctggtgtcctgccccaactacacctacgaggtggggtcctggatcggtttcgccatcatgacgcagtgtctcccagtggccctgttctccctggtgggcttcacccagatgaccatctgggccaagggcaagcaccgcagctacctgaaggagttccgggactacccgcccctgcgcatgcccatcatccccttcctgctctgagcgctcacccctgctgaggctcagcccctcaacccggtggcattctgggggaggagtggggcccacagctctccagcacccggaataaagcccgcctgccccagtcggaaaaaaaaaaaaaaa

SEQ ID NO: 314 - protein, 308 aa, Homo sapiens [sequence omitted]

SEQ ID NO: 315 - DNA, 3601 bp, Homo sapiens
ttttgaggggggcgcctcgtcccgcccctccctcctgtcctccctcccgtcctccccgctccgggccccacccggctcagacggctccggacgggaccgcgagcacaggccgctccgcgggcgcttcggatcctcgcgggaccccaccctctcccagcctgcccagcccgctgcagccgccagcgcgccccgtcggcagctctccatctgcacgtctctccgtgaaccccgtgagcggtgtgcagccaccatgttcagctggctgaagcggggcggggcacggggccagcagcccgaggccatccgcacggtgacctcggccctcaaggagctgtaccgcacgaagctgctgccgctggaggagcactaccgctttggggccttccactcgccggccctggaggacgcagacttcgacggcaagcccatggtgctggtggccggccagtacagcacgggcaagaccagcttcatccagtacctgctggagcaggaggtgcccggctcccgcgtggggcctgagcccaccaccgactgctttgtggccgtcatgcacggggacactgagggcaccgtgcccggcaacgccctcgtcgtggacccggacaagcccttccgcaaactcaaccctttcggaaacaccttcctcaacaggttcatgtgtgcccagctccctaatcaggtcctggagagcatcagcatcatcgacaccccgggtatcctgtcgggtgccaagcagagagtgagccgcggctacgacttcccggccgtgctgcgctggttcgcggagcgcgtggacctcatcatcctgctctttgatgcgcacaagctggagatctcggacgagttctcagaggccatcggcgcgttgcggggccatgaggacaagatccgcgtggtgctcaacaaggccgacatggtggagacgcagcagctgatgcgcgtctacggcgcgctcatgtgggcgctgggcaaggtggtgggcacgcccgaggtgctgcgcgtctacatcggctccttctggtcccagcccctcctcgtgcccgacaaccggcgcctcttcgagctggaggagcaggacctcttccgcgacatccagggcctgccccggcacgcagccttgcgcaagctcaacgacctggtgaagagggcccggctggtgcgagttcacgcttacatcatcagctacctgaagaaggagatgccctctgtgtttgggaaggagaacaagaagaagcagctgatcctcaaactgcccgtcatctttgcgaagattcagctggaacatcacatctcccctggggactttcctgattgccagaaaatgcaggagctgctgatggcgcacgacttcaccaagtttcactcgctgaagccgaagctgctagaggcactggacgagatgctgacgcacgacatcgccaagctcatgcccctgctgcggcaggaggagctggagagcaccgaggtgggcgtgcaggggggcgcttttgagggcacccacatgggcccgtttgtggagcggggacctgacgaggccatggaggacggcgaggagggctcggacgacgaggccgagtgggtggtgaccaaggacaagtccaaatacgacgagatcttctacaacctggcgcctgccgacggcaagctgagcggctccaaggccaagacctggatggtggggaccaagctccccaactcagtgctggggcgcatctggaagctcagcgatgtggaccgcgacggcatgctggatgatgaggagttcgcgctggccagccacctcatcgaggccaagctggaaggccacgggctgcccgccaacctgccccgtcgcctggtgccaccctccaagcgacgccacaagggctccgccgagtgagccggcccccctcccatggccctgctgtggctccccagctccagtcggctgcacgcacacccctgctccggctcacacacgccctgcctgccctccctgcccagctgtaaggaccgggggtctccctcctcactaccgccagacaccccggtggaagcatttagaggggaccacgggagggacaaggcttctctgtccgcccttcacacctccagcctcacgttcacttaggcacatcacacacacactggcacacgcaggcatccatccatccgtcattcattcaaatatttattgagcacctactatgtgcccagccctgttctaggcactgggcattaccatagagaacaaaatagacaaatacatctgccctcatggaaggtgacgttcccaggagagggcacctacacagtcacgcaaacacacactaattcctggcagggcccccagcccctcccctggctgagcagccctgtggctgaaatgactagcagataaacagacccccttctgctccgcttcctcctgcccagccaggcaacaccctcaaccggctccatcacatcctcaggtctcgggaccatggggggctcagaggggagacacacctactgcttcctcagatgggcccctccgcagccccttcccttgctcggggaaagcccccaattctgcccacacccatttatttccttccttccttccttcttttctttccttccttccttcttttttgtttttgcccccaattctgcccatacccatttctttctttccttccttccttcttttttgtttttgcccccagttctgtccacaccccttccctttcctgtcctgtcctttctttcttttttgatagaatcttgctctgtcgcccaggctggagtgcagtggtgagatctcagctcactgcaacctccacctcctgggttgaagtgattctcgtgcctcagcctcctgagtagctgggactgcaggcacgcgccaccacgcccagctaatttttgtatttgagtagagacggggtttcaccatgttggccaggctggtctcgaactccgcatctcaggtgatctgctcgccttggcctcccaaagtgatgggattacaggcatgagccaccgtgcccggcttcacacccatttctttaaaaaggatcccgtagcaggcagaaaagccccttccatcctgctcctctgatactgtgcccccttggagatatttccgtcctccacccacgtgtctgtggctggaactgcccagcctgctcctggccccctggaagcctccccacagctggtaatctggacttaaggattgctgggccaccgcctctctgcctaccaccattccatatttaagtggagcccctacgtagaaaggccccggggctttattttagtctccttttcagggatgtcgtgggcgggggagggggttcttggtgctacagccctctccccacccctaaagggacgccgacgctgtttgctgccttcaccacatattagtgcttgaccctggcaggggaccccatggaaaagatggggaagagcaaaatacatggagacgacgcaccctccaggatgctcgctgggattcccacgcccaccactgtcccccaccccatggctgggaggggcctctgaacggaacagtgtccccacagagcgaataaagccaaggcttcttcccaaaaaaaaaaaaaaaaaa

SEQ ID NO: 316 - protein, 543 aa, Homo sapiens
MFSWLKRGGARGQQPEAIRTVTSALKELYRTKLLPLEEHYRFGAFHSPALEDADFDGKPMVLVAGQYSTGKTSFIQYLLEQEVPGSRVGPEPTTDCFVAVMHGDTEGTVPGNALVVDPDKPFRKLNPFGNTFLNRFMCAQLPNQVLESISIIDTPGILSGAKQRVSRGYDFPAVLRWFAERVDLIILLFDAHKLEISDEFSEAIGALRGHEDKIRVVLNKADMVETQQLMRVYGALMWALGKVVGTPEVLRVYIGSFWSQPLLVPDNRRLFELEEQDLFRDIQGLPRHAALRKLNDLVKRARLVRVHAYIISYLKKEMPSVFGKENKKKQLILKLPVIFAKIQLEHHISPGDFPDCQKMQELLMAHDFTKFHSLKPKLLEALDEMLTHDIAKLMPLLRQEELESTEVGVQGGAFEGTHMGPFVERGPDEAMEDGEEGSDDEAEWVVTKDKSKYDEIFYNLAPADGKLSGSKAKTWMVGTKLPNSVLGRIWKLSDVDRDGMLDDEEFALASHLIEAKLEGHGLPANLPRRLVPPSKRRHKGSAE

SEQ ID NO: 317 - DNA, 2129 bp, Homo sapiens
tttccgcattgaaggggctgctccgaatggagggggaggggaggtgtttaggagaaagtaggggctgtgggtgtcgggagccggctgacgggtggacaagggggggttagcagctgggctgcgaccgttagggaggggctcaaggtgtgcatgtgtgagggaagagagagagagagaagggcgcctcagaggtgactttcagcctgcgagccttcttcccggggcgccataaacgcccccaatttcccagctgctaaaggaagaggaagatcttagcaaagcaatgtctcaagatggtgcttctcagttccaagaagtcattcggcaagagctagaattatctgtgaagaaggaactagaaaaaatactcaccacagcatcatcacatgaatttgagcacaccaaaaaagacctggatggatttcggaagctatttcatagatttttgcaagaaaaggggccttctgtggattggggaaaaatccagagaccccctgaagattcgattcaaccctatgaaaagataaaggccaggggcttgcctgataatatatcttccgtgttgaacaaactagtggtggtgaaactcaatggtggtttgggaaccagcatgggctgcaaaggccctaaaagtctgattggtgtgaggaatgagaatacctttctggatctgactgttcagcaaattgaacatttgaataaaacctacaatacagatgttcctcttgttttaatgaactcttttaacacggatgaagataccaaaaaaatactacagaagtacaatcattgtcgtgtgaaaatctacactttcaatcaaagcaggtacccgaggattaataaagaatctttacttcctgtagcaaaggacgtgtcttactcaggggaaaatacagaagcttggtaccctccaggtcatggtgatatttacgccagtttctacaactctggattgcttgatacctttataggagaaggcaaagagtatatttttgtgtctaacatagataatctgggtgccacagtggatctgtatattcttaatcatctaatgaacccacccaatggaaaacgctgtgaatttgtcatggaagtcacaaataaaacacgtgcagatgtaaagggcgggacactcactcaatatgaaggcaaactgagactggtggaaattgctcaagtgccaaaagcacatgtagacgagttcaagtctgtatcaaagttcaaaatatttaatacaaacaacctatggatttctcttgcagcagttaaaagactgcaggagcaaaatgccattgacatggaaatcattgtgaatgcaaagactttggatggaggcctgaatgtcattcaattagaaactgcagtaggggctgccatcaaaagttttgagaattctctaggtattaatgtgccaaggagccgttttctgcctgtcaaaaccacatcagatctcttgctggtgatgtcaaacctctatagtcttaatgcaggatctctgacaatgagtgaaaagcgggaatttcctacagtgcccttggttaaattaggcagttcttttacgaaggttcaagattatctaagaagatttgaaagtataccagatatgcttgaattggatcacctcacagtttcaggagatgtgacatttggaaaaaatgtttcattaaagggaacggttatcatcattgcaaatcatggtgacagaattgatatcccacctggagcagtattagagaacaagattgtgtctggaaaccttcgcatcttggaccactgaaatgaaaaatactgtggacacttaaataatgggctagtttcttacaatgaaatgttctctaggattctaaaataggcaggtactttactatgttactgtaccctgcagtgttgatttttaaaatagagttttctgcagtatgcttttagtctaagaaaagcacagatggagcaatactttccttctttgaagagaatcccaaaagttagttcatcttaaagtgcaatattgtttaatcttaaaactgggcaactttggaagaacttttaacagaagcctcaatgatgatcactttgaattgcttgtgatttcaaaaataaagcagtgaagcaataaaaaaaaaaaaaaaaaa

SEQ ID NO: 318 - protein, 497 aa, Homo sapiens
MSQDGASQFQEVIRQELELSVKKELEKILTTASSHEFEHTKKDLDGFRKLFHRFLQEKGPSVDWGKIQRPPEDSIQPYEKIKARGLPDNISSVLNKLVVVKLNGGLGTSMGCKGPKSLIGVRNENTFLDLTVQQIEHLNKTYNTDVPLVLMNSFNTDEDTKKILQKYNHCRVKIYTFNQSRYPRINKESLLPVAKDVSYSGENTEAWYPPGHGDIYASFYNSGLLDTFIGEGKEYIFVSNIDNLGATVDLYILNHLMNPPNGKRCEFVMEVTNKTRADVKGGTLTQYEGKLRLVEIAQVPKAHVDEFKSVSKFKIFNTNNLWISLAAVKRLQEQNAIDMEIIVNAKTLDGGLNVIQLETAVGAAIKSFENSLGINVPRSRFLPVKTTSDLLLVMSNLYSLNAGSLTMSEKREFPTVPLVKLGSSFTKVQDYLRRFESIPDMLELDHLTVSGDVTFGKNVSLKGTVIIIANHGDRIDIPPGAVLENKIVSGNLRILDH

SEQ ID NO: 319 - DNA, 3013 bp, Homo sapiens
gtgaaggaaatagggacctggccctgggccttgtgtagcgggagggggagctaggaagcagctgagggcagaatccaggagggcctggctgcgggggaatgaagcctccgccttcgcaggcaaaagcctttaaatacgggctcaggcccgggactcagagtgtaacgcgtggcagcctgagggaggggcgtgcgccgagagggagctcagatcgagcggggcgcgggtggagaagctgcggcggcgcggcccgtaggaaggtgctgtccgaacgatcgggataggagcggtccctgcgcttgctgctgggaagtggtacaatcatgtttgaaattaagaagatctgttgcatcggtgcaggctatgttggaggacccacatgtagtgtcattgctcatatgtgtcctgaaatcagggtaacggttgttgatgtcaatgaatcaagaatcaatgcgtggaattctcctacacttcctatttatgagccaggactaaaagaagtggtagaatcctgtcgaggaaaaaatctttttttttctaccaatattgatgatgccatcaaagaagctgatcttgtatttatttctgtgctgtccaaccctgagtttctggcagagggaacagccatcaaggacctaaagaacccagacagagtactgattggaggggatgaaactccagagggccagagagctgtgcaggccctgtgtgctgtatatgagcactgggttcccagagaaaagatcctcaccactaatacttggtcttcagagctttccaaactggcagcaaatgcttttcttgcccagagaataagcagcattaactccataagtgctctgtgtgaagcaacaggagctgatgtagaagaggtagcaacagcgattggaatggaccagagaattggaaacaagtttctaaaagccagtgttgggtttggtgggagctgtttccaaaaggatgttctgaatttggtttatctctgtgaggctctgaatttgccagaagtagctcgttattggcagcaggtcatagacatgaatgactaccagaggaggaggtttgcttcccggatcatagatagtctgtttaatacagtaactgataagaagatagctattttgggatttgcattcaaaaaggacactggtgatacaagagaatcttctagtatatatattagcaaatatttgatggatgaaggtgcacatctacatatatatgatccaaaagtacctagggaacaaatagttgtggatctttctcatccaggtgtttcagaggatgaccaagtgtcccggctcgtgaccatttccaaggatccatatgaagcatgtgatggtgcccatgctgttgttatttgcactgagtgggacatgtttaaggaattggattatgaacgcattcataaaaaaatgctaaagccagcctttatcttcgatggacggcgtgtcctggatgggctccacaatgaactacaaaccattggcttccagattgaaacaattggcaaaaaggtgtcttcaaagagaattccatatgctccttctggtgaaattccgaagtttagtcttcaagatccacctaacaagaaacctaaagtgtagagattgccatttttatttgtgattttttttttttttttttggtacttcaggatagcaaatatctatctgctattaaatggtaaatgaaccaagtgtttttttttgttttttttttgagacagagtctcactgttgcccaggctggagtgcagtggtgcaatctcggctcactgcaagctctgcttcccaggttcacgccattctcctggctcagcctcccaagtagctgggactacaggcacccgccacagtgcctggctaattttttgtatttttagtagagacagggtttcaccatgtgagccaggatggtctcaatctcctgaccttgtgaaccacccgtctcggcctcccaaagtgctgggattacaggtgtgagccaccacgcctggcccatgaaccaagtgtttttaaggaaacaaaactatttttttaatcatcagatttatactagctatatggatattagcatatctggtaattatgaatctagaatttttttacatatttttataatactgttagctcagttattggatgagtgaaagataatcatgttggttttaatagtgtcaatttttgtaaaataaaaattaaacttcaaactctttactttataaattgtccataggccacactttaatatcacattataaagggaaggacagtcttcattcctcctggttattggtttgtttgtcattaaagatatattttgaatccatgaaattgctatgctaaacagcctttacatgtatggtctggttaaagttcctttgttccttttgttttaataaaatgtgtcactgattttttagctcaaaatcatcactgttaatttccagtcaccccaaatatggttaaaagattttttttttaatcatgaagagaaaattagtagcatttctttctctccccattatttattggttttcctcactaatctttttttttttagtccaaaagccaaaaatatttatcttggttttacattttaatttccattcttaattgtaatttttttctttaaataaggaaaccaatataatctcatgtataaaaacttaaatattttacaagttacatatagcatcattctaaaataagaattttttttgttttctgtctgcttttttcttatgtctcttgttgagttttatattttcagtggttatttttgcttgtgttagatcattattaaaatatatccaatgtccctttgatacttgtgctctgctgagaatgtacagtttgcattaaacatcccaggtctcatccttcaggaattttgcagttcaatgagaagagggagacaaatataaagatgaggacagaagcatctctacagatgaaaattacataaataaaacattctccatcaacaactaaaaaaaaaaaaaaaaaaa

SEQ ID NO: 320 - protein, 427 aa, Homo sapiens
MFEIKKICCIGAGYVGGPTCSVIAHMCPEIRVTVVDVNESRINAWNSPTLPIYEPGLKEVVESCRGKNLFFSTNIDDAIKEADLVFISVLSNPEFLAEGTAIKDLKNPDRVLIGGDETPEGQRAVQALCAVYEHWVPREKILTTNTWSSELSKLAANAFLAQRISSINSISALCEATGADVEEVATAIGMDQRIGNKFLKASVGFGGSCFQKDVLNLVYLCEALNLPEVARYWQQVIDMNDYQRRRFASRIIDSLFNTVTDKKIAILGFAFKKDTGDTRESSSIYISKYLMDEGAHLHIYDPKVPREQIVVDLSHPGVSEDDQVSRLVTISKDPYEACDGAHAVVICTEWDMFKELDYERIHKKMLKPAFIFDGRRVLDGLHNELQTIGFQIETIGKKVSSKRIPYAPSGEIPKFSLQDPPNKKPKV

SEQ ID NO: 321 - DNA, 2342 bp, Homo sapiens
tggcgcgggcaatccctcaacctgattggtcccctcgcccgtcactccagtgcgcccccaacctaccacgcagtaaaagccacccccgcctcggcccggacggtttccaagctggttttgaagtcgcggcagctgttcctgggacgtccggttgaccgcgcgtctgctgcagagaccatgtctgccgacggggcagaggctgatggcagcacccaggtgacagtggaagaaccggtacagcagcccagtgtggtggaccgtgtggccagcatgcctctgatcagctccacctgcgacatggtgtccgcagcctatgcctccaccaaggagagctacccgcacatcaagactgtctgcgacgcagcagagaagggagtgaggaccctcacggcggctgctgtcagcggggctcagccgatcctctccaagctggagccccagattgcatcagccagcgaatacgcccacagggggctggacaagttggaggagaacctccccatcctgcagcagcccacggagaaggtcctggcggacaccaaggagcttgtgtcgtctaaggtgtcgggggcccaagagatggtgtctagcgccaaggacacggtggccacccaattgtcggaggcggtggacgcgacccgcggtgctgtgcagagcggcgtggacaagacaaagtccgtagtgaccggcggcgtccaatcggtcatgggctcccgcttgggccagatggtgttgagtggggtcgacacggtgctggggaagtcggaggagtgggcggacaaccacctgccccttacggatgccgaactggcccgcatcgccacatccctggatggctttgacgtcgcgtccgtgcagcagcagcggcaggaacagagctacttcgtacgtctgggctccctgtcggagaggctgcggcagcacgcctatgagcactcgctgggcaagcttcgagccaccaagcagagggcacaggaggctctgctgcagctgtcgcaggtcctaagcctgatggaaactgtcaagcaaggcgttgatcagaagctggtggaaggccaggagaagctgcaccagatgtggctcagctggaaccagaagcagctccagggccccgagaaggagccgcccaagccagaggtcgagtcccgggcgctcaccatgttccgggacattgcccagcaactgcaggccacctgtacctccctggggtccagcattcagggcctccccaccaatgtgaaggaccaggtgcagcaggcccgccgccaggtggaggacctccaggccacgttttccagcatccactccttccaggacctgtccagcagcattctggcccagagccgtgagcgtgtcgccagcgcccgcgaggccctggaccacatggtggaatatgtggcccagaacacacctgtcacgtggctcgtgggaccctttgcccctggaatcactgagaaagccccggaggagaagaagtagggggagaggagaggactcagcgggccccgtctctataatgcagctgtgctctggagtcctcaacccggggctcatttcaaacttattttctagccactcctcccagctcttctgtgctgtccacttgggaagctaaggctctcaaaacgggcatcacccagttgacccatctctcagcctctctgagcttggaagaagcctgttctgagcctcaccctatcagtcagtagagagagatgtccagaaaaaatatctttcaggaaagttctcccctgcagaattttttttccttgttaaatatcaggaatataggccgggtgcggtggctcacacctgtaatcccagcactttgggaggctgaggcgggcggaacacctgaggtcaggtgttcgagaccagccaggccaacatggtgaaaccccgtctctactaaaaatacaaaaaaaaatgagccgggcatggtagcaggtgtctgttatcccagttaggaggctgaggcaagagaatctcttgaacctgagaggcggaggttgcagtgagccaagatcgcgccattgcactccagcctgggggacaagagtgagacttagtctcaaaaaaaaaaaaaaagaaaaaaaaatcagggatatagttcatatcccacttctttgtttacaccgatgtccctgaatatcagcctgtagctaatggacttgggatttctggtctaagtgggcctcctggggatggggtggtacactgagcttctgagcctcattgtagagtagaaaggtactggggcctgtgtggtaagccttgttgaaatgctctggtattcagtattgccttaataaacttcacccacaactgcatacaggcaaaaa

SEQ ID NO: 322 - protein, 433 aa, Homo sapiens
MSADGAEADGSTQVTVEEPVQQPSVVDRVASMPLISSTCDMVSAAYASTKESYPHIKTVCDAAEKGVRTLTAAAVSGAQPILSKLEPQIASASEYAHRGLDKLEENLPILQQPTEKVLADTKELVSSKVSGAQEMVSSAKDTVATQLSEAVDATRGAVQSGVDKTKSVVTGGVQSVMGSRLGQMVLSGVDTVLGKSEEWADNHLPLTDAELARIATSLDGFDVASVQQQRQEQSYFVRLGSLSERLRQHAYEHSLGKLRATKQRAQEALLQLSQVLSLMETVKQGVDQKLVEGQEKLHQMWLSWNQKQLQGPEKEPPKPEVESRALTMFRDIAQQLQATCTSLGSSIQGLPTNVKDQVQQARRQVEDLQATFSSIHSFQDLSSSILAQSRERVASAREALDHMVEYVAQNTPVTWLVGPFAPGITEKAPEEKK

SEQ ID NO: 323 - DNA, 1064 bp, Homo sapiens
cgccgtcatttcggagcgactcagcgcctgcccgccctctcgccgcgtcgccggtgcctgcgcctcccgctccacctcgcttcttctctcccggccgaggcccgggggaccagagcgagaagcggggaccatgttccgacgcaagttgacggctctcgactaccacaaccccgccggcttcaactgcaaagatgaaacagaatttagaaacttcatcgtttggcttgaagaccagaaaatcaggcactacaagattgaagacagagggaatttaagaaacatccacagcagcgactggcccaagttctttgaaaagtatctcagagatgttaactgtcctttcaagattcaagatcgacaagaagctattgactggcttcttggtttagctgttagacttgaatatggagataatgctgaaaaatacaaggatttagtacctgataattcaaaaactgctgacaatgcaactaaaaatgcagaaccattgatcaatttggatgtaaataatcctgattttaaggctggtgtgatggctttggctaacctgcttcagattcagcgtcatgatgattacctggtaatgcttaaggcaattcggattttggttcaggagcgcctgacacaggatgcagttgctaaggcaaatcaaacaaaagagggcttacctgttgctttagacaaacatattcttggttttgacacaggagatgcagttcttaatgaagctgctcaaattctgcgattgctgcacatagaggagctcagagagctacagacaaaaatcaacgaagccatagtagctgttcaggcaattattgctgatccaaagacagaccacagactgggaaaagttggaagatgaacacttgaggacttcagcttctcacctacttagtacagttgggaaccatacacttctggcatgtttggaaatcaaaatgtcacattctcgggggaggaagcccagaaaattgggtatgttctagagatttaccaccattgcttattgcttttttctttaataaagtttaggaaagtagaatttttaaaaaaaaaaaaaa

SEQ ID NO: 324 - protein, 244 aa, Homo sapiens
MFRRKLTALDYHNPAGFNCKDETEFRNFIVWLEDQKIRHYKIEDRGNLRNIHSSDWPKFFEKYLRDVNCPFKIQDRQEAIDWLLGLAVRLEYGDNAEKYKDLVPDNSKTADNATKNAEPLINLDVNNPDFKAGVMALANLLQIQRHDDYLVMLKAIRILVQERLTQDAVAKANQTKEGLPVALDKHILGFDTGDAVLNEAAQILRLLHIEELRELQTKINEAIVAVQAIIADPKTDHRLGKVGR

SEQ ID NO: 325 - DNA, 1940 bp, Homo sapiens
gcggttcggcgcggaaagcgggaggtggaggggcggcttggggcaagcgcgcgcgcgcagtgcagaagccagccccccgcggctgaggtactcaaggtgcccaaaggcggggtagtgacctcgcgcgtgcgctgtgcccgcggcagcgccgggtcctagtgtgtgggttgttgttggcaccgcacggcgcgtgcgcagtgaggacggcggagggatttgcggccgggacccaccccctgctccagtcgctatcggaggccgcgcgggtggctgagcagcggcctggtgcgctcgcttagcgggcgacggaatcagacggacgtggacgcccccggagtggaagccgaagcaggagttgttgttgctgaggggctgccgcagccgccgcgagcctccggacagacgccagagcgaggagggcgctacgcgacttggcaagatgacccagttcctgccgcccaaccttctggccctctttgccccccgtgaccctattccatacctgccacccctggagaaactgccacatgaaaaacaccacaatcaaccttattgtggcattgcgccgtacattcgagagtttgaggaccctcgagatgcccctcctccaactcgtgctgaaacccgagaggagcgcatggagaggaaaagacgggaaaagattgagcggcgacagcaagaagtggagacagagcttaaaatgtgggaccctcacaatgatcccaatgctcagggggatgccttcaagactctcttcgtggcgagagtgaattatgacacaacagaatccaagctccggagagagtttgaggtgtacggacctatcaaaagaatacacatggtctacagtaagcggtcaggaaagccccgtggctatgccttcatcgagtacgaacacgagcgagacatgcactccgcttacaaacacgcagatggcaagaagattgatggcaggagggtccttgtggacgtggagaggggccgaaccgtgaagggctggaggccccggcggctaggaggaggcctcggtggtaccagaagaggaggggctgatgtgaacatccggcattcaggccgcgatgacacctcccgctacgatgagaggcccggcccctccccgcttccgcacagggaccgggaccgggaccgtgagcgggagcgcagagagcggagccgggagcgagacaaggagcgagaacggcgacgctcccgctcccgggaccggcggaggcgctcacggagtcgcgacaaggaggagcggaggcgctccagggagcggagcaaggacaaggaccgggaccggaagcggcgaagcagccggagtcgggagcgggcccggcgggagcgggagcgcaaggaggagctgcgtggcggcggtggcgacatggcggagccctccgaggcgggtgacgcgccccctgatgatgggcctccaggggagctcgggcctgacggccctgacggtccagaggaaaagggccgggatcgtgaccgggagcgacggcggagccaccggagcgagcgcgagcggcgccgggaccgggatcgtgaccgtgaccgtgaccgcgagcacaaacggggggagcggggcagtgagcggggcagggatgaggcccgaggtgggggcggtggccaggacaacgggctggagggtctgggcaacgacagccgagacatgtacatggagtctgagggcggcgacggctacctggctccggagaatgggtatttgatggaggctgcgccggagtgaagaggtcgtcctctccatctgctgtgtttggacgcgttcctgcccagccccttgctgtcatcccctcccccaaccttggccacttgagtttgtcctccaagggtaggtgtctcatttgttctggccccttggatttaaaaataaaattaatttcctgttgatagtgggcaaaaaaaaaaaaaaaaaa

SEQ ID NO: 326 - protein, 437 aa, Homo sapiens
MTQFLPPNLLALFAPRDPIPYLPPLEKLPHEKHHNQPYCGIAPYIREFEDPRDAPPPTRAETREERMERKRREKIERRQQEVETELKMWDPHNDPNAQGDAFKTLFVARVNYDTTESKLRREFEVYGPIKRIHMVYSKRSGKPRGYAFIEYEHERDMHSAYKHADGKKIDGRRVLVDVERGRTVKGWRPRRLGGGLGGTRRGGADVNIRHSGRDDTSRYDERPGPSPLPHRDRDRDRERERRERSRERDKERERRRSRSRDRRRRSRSRDKEERRRSRERSKDKDRDRKRRSSRSRERARRERERKEELRGGGGDMAEPSEAGDAPPDDGPPGELGPDGPDGPEEKGRDRDRERRRSHRSERERRRDRDRDRDRDREHKRGERGSERGRDEARGGGGGQDNGLEGLGNDSRDMYMESEGGDGYLAPENGYLMEAAPE

SEQ ID NO: 327 - DNA, 2478 bp, Homo sapiens
gaaagagtgagagccgcccacgagctctgagcagagagcccgcaggagtgccacgtcccggcggcctcggcccctccctgcctcagtttcccgtggcatcaaagggggcgaggggcccctccaggcctctggtgacgggggtgctgtgcccaggcgggggtccgggggcgaccgagggggctcaggaagtccgcggccgcaggaattcggcgcctccaggccttataaggacatttgcgctccgggccaatcagcggcgggggcgtggcgcgcggagcccggcgcgtcccaaccccgcgccagcccggcggtcccgtcccgtcccgtcctgtgcggccccgtcccgccgcccgcccgccagccatgagctccacgcagttcaacaagggcccctcgtacgggctgtcggccgaggtcaagaaccggctcctgtccaaatatgacccccagaaggaggcagagctccgcacctggatcgagggactcaccggcctctccatcggccccgacttccagaagggcctgaaggatggaactatcttatgcacactcatgaacaagctacagccgggctccgtccccaagatcaaccgctccatgcagaactggcaccagctagaaaacctgtccaacttcatcaaggccatggtcagctacggcatgaaccctgtggacctgttcgaggccaacgacctgtttgagagtgggaacatgacgcaggtgcaggtgtctcttctcgccctggcggggaaggccaagactaaggggctgcagagcggggtggacattggcgtcaagtactcggagaagcaggagcggaatttcgacgatgccaccatgaaggctggccagtgcgtcatcgggctgcagatgggcaccaacaaatgcgccagccagtcgggcatgactgcctacggcacgagaaggcatctctatgaccccaagaaccatatcctgccccccatggaccactcgaccatcagcctccagatgggcacgaacaagtgtgccagccaggtgggcatgacggctcccgggacccggcggcacatctatgataccaagctgggaaccgacaagtgtgacaactcctccatgtccctgcagatgggctacacgcagggcgccaaccagagcggccaggtcttcggcctgggccggcagatatatgaccccaagtactgcccgcaaggcacagtggccgatggggctccctcgggcaccggcgactgcccggacccgggggaggtccctgaatatcccccttactaccaggaggaggccggctactgaggctcccagcacgctctctccccacatcgtctgcccatctgggtttttgggtttttctgtgttttcatcttttttttttttttcttaacccgttcagtgctgccagtcaaccaagggtctgtgagtgtcagcgtgggatcaggcagcagagcttttttcccctttgccttgatccttcgcaaggctgagccactgggctgtgggggaaggggtcaaggccatatcccaatacgtgtagggcgagggtccctgctggcacattcaggctgtgctgggaagaagagacctgggcttggaaggaaccggtccccgacggtttctgcttgcctcgcctcttcccccttttgtcagctgagcagtttgtggtttctatgcccgcaagtttcaggaagtattcacaaaagaaaaatacattttttcccccaggggtggggcaaggacagtggagagagtgctaggaaatgagtcccctgggaaaggggaccgggccgtgatgttaaatatctccggctcccaagtgactggatttgcctaggaccttcagatcaacagacttcagaccctcagacctgccccggggccaggtggagaaagtgagggccgtacaaggaagtgaaattctgagttgttggggctaagcctgaccccctctccatgctccccgccccaactcactctggcctcagtagatttttttttcagttgtggttgttgcccaggctggagtgcagtggcgccatcttggctcactgcacctccaccttccgggctcaagcgattctccagcctcagcctcctgagtagctaggactgcaggtgctccaccacgcccggctaatttttgtatttttagtagagatggggtttccccatgttggccaggctggtctcgaactcctggcctcaggtgtgatccgcccgcctccgcctccccaagcgctgagattacaggtgtgagccaccgtgcccaggccctcagtaggttttaaggagtccccagccctcctcccttctgggcccgaccagcttatactgctccatcttccccggccacatgccccgccaagtactgcacagggaccccccacccaggggccctgctccgtgagataatgtgaaatacgactgtggaccaaacgcaataaaacctctgtttgtacgaagaaaaaaaaaaaaaaaaaaaaa

SEQ ID NO: 328 - protein, 309 aa, Homo sapiens
MSSTQFNKGPSYGLSAEVKNRLLSKYDPQKEAELRTWIEGLTGLSIGPDFQKGLKDGTILCTLMNKLQPGSVPKINRSMQNWHQLENLSNFIKAMVSYGMNPVDLFEANDLFESGNMTQVQVSLLALAGKAKTKGLQSGVDIGVKYSEKQERNFDDATMKAGQCVIGLQMGTNKCASQSGMTAYGTRRHLYDPKNHILPPMDHSTISLQMGTNKCASQVGMTAPGTRRHIYDTKLGTDKCDNSSMSLQMGYTQGANQSGQVFGLGRQIYDPKYCPQGTVADGAPSGTGDCPDPGEVPEYPPYYQEEAGY

SEQ ID NO: 329 - DNA, 1507 bp, Homo sapiens
tgggcggcggctgaggcgcgtgctctcgcgtggtcgctgggtctgcgtcttcccgagccagtgtgctgagctctccgcgtcgcctctgtcgcccgcgcctggcctaccgcggcactcccggctgcacgctctgcttggcctcgccatgccggtggacctcagcaagtggtccgggcccttgagcctgcaagaagtggacgagcagccgcagcacccgctgcatgtcacctacgccggggcggcggtggacgagctgggcaaagtgctgacgcccacccaggttaagaatagacccaccagcatttcgtgggatggtcttgattcagggaagctctacaccttggtcctgacagacccggatgctcccagcaggaaggatcccaaatacagagaatggcatcatttcctggtggtcaacatgaagggcaatgacatcagcagtggcacagtcctctccgattatgtgggctcggggcctcccaagggcacaggcctccaccgctatgtctggctggtttacgagcaggacaggccgctaaagtgtgacgagcccatcctcagcaaccgatctggagaccaccgtggcaaattcaaggtggcgtccttccgtaaaaagtatgagctcagggccccggtggctggcacgtgttaccaggccgagtgggatgactatgtgcccaaactgtacgagcagctgtctgggaagtagggggttagcttggggacctgaactgtcctggaggccccaagccatgttccccagttcagtgttgcatgtataatagatttctcctcttcctgccccccttggcatgggtgagacctgaccagtcagatggtagttgagggtgacttttcctgctgcctggcctttataattttactcactcactctgatttatgttttgatcaaatttgaacttcattttggggggtattttggtactgtgatggggtcatcaaattattaatctgaaaatagcaacccagaatgtaaaaaagaaaaaactggggggaaaaagaccaggtctacagtgatagagcaaagcatcaaagaatctttaagggaggtttaaaaaaaaaaaaaaaaaaaaagattggttgcctctgcctttgtgatcctgagtccagaatggtacacaatgtgattttatggtgatgtcactcacctagacaaccagaggctggcattgaggctaacctccaacacagtgcatctcagatgcctcagtaggcatcagtatgtcactctggtccctttaaagagcaatcctggaagaagcaggagggagggtggctttgctgttgttgggacatggcaatctagaccggtagcagcgctcgctgacagcttgggaggaaacctgagatctgtgttttttaaattgatcgttcttcatgggggtaagaaaagctggtctggagttgctgaatgttgcattaattgtgctgtttgcttgtagttgaataaaaatagaaacctgaatgaagaaaaaaaaaaaaaaaa

SEQ ID NO: 330 - protein, 187 aa, Homo sapiens
MPVDLSKWSGPLSLQEVDEQPQHPLHVTYAGAAVDELGKVLTPTQVKNRPTSISWDGLDSGKLYTLVLTDPDAPSRKDPKYREWHHFLVVNMKGNDISSGTVLSDYVGSGPPKGTGLHRYVWLVYEQDRPLKCDEPILSNRSGDHRGKFKVASFRKKYELRAPVAGTCYQAEWDDYVPKLYEQLSGK

SEQ ID NO: 331 - DNA, 4450 bp, Homo sapiens
agccgatgggggcggggaaaagtccggctgggccgggacaaaagccggatcccgggaagctaccggctgctggggtgctccggattttgcggggttcgtcgggcctgtggaagaagcgccgcgcacggacttcggcagaggtagagcaggtctctctgcagccatgtcggccaaggcaatttcagagcagacgggcaaagaactcctttacaagttcatctgtaccacctcagccatccagaatcggttcaagtatgctcgggtcactcctgacacagactgggcccgcttgctgcaggaccacccctggctgctcagccagaacttggtagtcaagccagaccagctgatcaaacgtcgtggaaaacttggtctcgttggggtcaacctcactctggatggggtcaagtcctggctgaagccacggctgggacaggaagccacagttggcaaggccacaggcttcctcaagaactttctgatcgagcccttcgtcccccacagtcaggctgaggagttctatgtctgcatctatgccacccgagaaggggactacgtcctgttccaccacgaggggggtgtggacgtgggtgatgtggacgccaaggcccagaagctgcttgttggcgtggatgagaaactgaatcctgaggacatcaaaaaacacctgttggtccacgcccctgaagacaagaaagaaattctggccagttttatctccggcctcttcaatttctacgaggacttgtacttcacctacctcgagatcaatccccttgtagtgaccaaagatggagtctatgtccttgacttggcggccaaggtggacgccactgccgactacatctgcaaagtgaagtggggtgacatcgagttccctccccccttcgggcgggaggcatatccagaggaagcctacattgcagacctcgatgccaaaagtggggcaagcctgaagctgaccttgctgaaccccaaagggaggatctggaccatggtggccgggggtggcgcctctgtcgtgtacagcgataccatctgtgatctagggggtgtcaacgagctggcaaactatggggagtactcaggcgcccccagcgagcagcagacctatgactatgccaagactatcctctccctcatgacccgagagaagcacccagatggcaagatcctcatcattggaggcagcatcgcaaacttcaccaacgtggctgccacgttcaagggcatcgtgagagcaattcgagattaccagggccccctgaaggagcacgaagtcacaatctttgtccgaagaggtggccccaactatcaggagggcttacgggtgatgggagaagtcgggaagaccactgggatccccatccatgtctttggcacagagactcacatgacggccattgtgggcatggccctgggccaccggcccatccccaaccagccacccacagcggcccacactgcaaacttcctcctcaacgccagcgggagcacatcgacgccagcccccagcaggacagcatctttttctgagtccagggccgatgaggtggcgcctgcaaagaaggccaagcctgccatgccacaagattcagtcccaagtccaagatccctgcaaggaaagagcaccaccctcttcagccgccacaccaaggccattgtgtggggcatgcagacccgggccgtgcaaggcatgctggactttgactatgtctgctcccgagacgagccctcagtggctgccatggtctaccctttcactggggaccacaagcagaagttttactgggggcacaaagagatcctgatccctgtcttcaagaacatggctgatgccatgaggaagcatccggaggtagatgtgctcatcaactttgcctctctccgctctgcctatgacagcaccatggagaccatgaactatgcccagatccggaccatcgccatcatagctgaaggcatccctgaggccctcacgagaaagctgatcaagaaggcggaccagaagggagtgaccatcatcggacctgccactgttggaggcatcaagcctgggtgctttaagattggcaacacaggtgggatgctggacaacatcctggcctccaaactgtaccgcccaggcagcgtggcctatgtctcacgttccggaggcatgtccaacgagctcaacaatatcatctctcggaccacggatggcgtctatgagggcgtggccattggtggggacaggtacccgggctccacattcatggatcatgtgttacgctatcaggacactccaggagtcaaaatgattgtggttcttggagagattgggggcactgaggaatataagatttgccggggcatcaaggagggccgcctcactaagcccatcgtctgctggtgcatcgggacgtgtgccaccatgttctcctctgaggtccagtttggccatgctggagcttgtgccaaccaggcttctgaaactgcagtagccaagaaccaggctttgaaggaagcaggagtgtttgtgccccggagctttgatgagcttggagagatcatccagtctgtatacgaagatctcgtggccaatggagtcattgtacctgcccaggaggtgccgcccccaaccgtgcccatggactactcctgggccagggagcttggtttgatccgcaaacctgcctcgttcatgaccagcatctgcgatgagcgaggacaggagctcatctacgcgggcatgcccatcactgaggtcttcaaggaagagatgggcattggcggggtcctcggcctcctctggttccagaaaaggttgcctaagtactcttgccagttcattgagatgtgtctgatggtgacagctgatcacgggccagccgtctctggagcccacaacaccatcatttgtgcgcgagctgggaaagacctggtctccagcctcacctcggggctgctcaccatcggggatcggtttgggggtgccttggatgcagcagccaagatgttcagtaaagcctttgacagtggcattatccccatggagtttgtgaacaagatgaagaaggaagggaagctgatcatgggcattggtcaccgagtgaagtcgataaacaacccagacatgcgagtgcagatcctcaaagattacgtcaggcagcacttccctgccactcctctgctcgattatgcactggaagtagagaagattaccacctcgaagaagccaaatcttatcctgaatgtagatggtctcatcggagtcgcatttgtagacatgcttagaaactgtgggtcctttactcgggaggaagctgatgaatatattgacattggagccctcaatggcatctttgtgctgggaaggagtatggggttcattggacactatcttgatcagaagaggctgaagcaggggctgtatcgtcatccgtgggatgatatttcatatgttcttccggaacacatgagcatgtaacagagccaggaaccctactgcagtaaactgaagacaagatctcttcccccaagaaaaagtgtacagacagctggcagtggagcctgctttatttagcaggggcctggaatgtaaacagccactggggtacaggcaccgaagaccaacatccacaggctaacaccccttcagtccacacaaagaagcttcatattttttttataagcatagaaataaaaaccaagccaatatttgtgactttgctctgctacctgctgtatttattatatggaagcatctaagtactgtcaggatggggtcttcctcattgtagggcgttaggatgttgctttctttttccattagttaaacatttttttctcctttggaggaagggaatgaaacatttatggcctcaagatactatacatttaaagcaccccaatgtctctctttttttttttttacttccctttcttcttccttatataacatgaagaacattgtattaatctgatttttaaagatctttttgtatgttacgtgttaagggcttgtttggtatcccactgaaatgttctgtgttgcagaccagagtctgtttatgtcagggggatggggccattgcatccttagccattgtcacaaaatatgtggagtagtaacttaatatgtaaagttgtaacatacatacatttaaaatggaaatgcagaaagctgtgaaatgtcttgtgtcttatgttctctgtatttatgcagctgatttgtctgtctgtaactgaagtgtgggtccaaggactcctaactactttgcatctgtaatccacaaagattctgggcagctgccacctcagtctcttctctgtattatcatagtctggtttaaataaactatatagtaacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 332 - protein, 1101 aa, Homo sapiens
MSAKAISEQTGKELLYKFICTTSAIQNRFKYARVTPDTDWARLLQDHPWLLSQNLVVKPDQLIKRRGKLGLVGVNLTLDGVKSWLKPRLGQEATVGKATGFLKNFLIEPFVPHSQAEEFYVCIYATREGDYVLFHHEGGVDVGDVDAKAQKLLVGVDEKLNPEDIKKHLLVHAPEDKKEILASFISGLFNFYEDLYFTYLEINPLVVTKDGVYVLDLAAKVDATADYICKVKWGDIEFPPPFGREAYPEEAYIADLDAKSGASLKLTLLNPKGRIWTMVAGGGASVVYSDTICDLGGVNELANYGEYSGAPSEQQTYDYAKTILSLMTREKHPDGKILIIGGSIANFTNVAATFKGIVRAIRDYQGPLKEHEVTIFVRRGGPNYQEGLRVMGEVGKTTGIPIHVFGTETHMTAIVGMALGHRPIPNQPPTAAHTANFLLNASGSTSTPAPSRTASFSESRADEVAPAKKAKPAMPQDSVPSPRSLQGKSTTLFSRHTKAIVWGMQTRAVQGMLDFDYVCSRDEPSVAAMVYPFTGDHKQKFYWGHKEILIPVFKNMADAMRKHPEVDVLINFASLRSAYDSTMETMNYAQIRTIAIIAEGIPEALTRKLIKKADQKGVTIIGPATVGGIKPGCFKIGNTGGMLDNILASKLYRPGSVAYVSRSGGMSNELNNIISRTTDGVYEGVAIGGDRYPGSTFMDHVLRYQDTPGVKMIVVLGEIGGTEEYKICRGIKEGRLTKPIVCWCIGTCATMFSSEVQFGHAGACANQASETAVAKNQALKEAGVFVPRSFDELGEIIQSVYEDLVANGVIVPAQEVPPPTVPMDYSWARELGLIRKPASFMTSICDERGQELIYAGMPITEVFKEEMGIGGVLGLLWFQKRLPKYSCQFIEMCLMVTADHGPAVSGAHNTIICARAGKDLVSSLTSGLLTIGDRFGGALDAAAKMFSKAFDSGIIPMEFVNKMKKEGKLIMGIGHRVKSINNPDMRVQILKDYVRQHFPATPLLDYALEVEKITTSKKPNLILNVDGLIGVAFVDMLRNCGSFTREEADEYIDIGALNGIFVLGRSMGFIGHYLDQKRLKQGLYRHPWDDISYVLPEHMSM

SEQ ID NO: 333 - DNA, 2440 bp, Homo sapiens
ttttgattgccatttccttgggacagcctgaagagagaatcgaaagaagttcttttcagtatggttgcataacatcgagtcggagattgtgaaatgtcctttgagaaaaatgtacgggcaggaagatgaataggtgtctgtttgattaaggctctccttcggaaagatgtcggacacggcagtagctgatacccggcgccttaactcgaagccgcaggacctgaccgacgcttacgggccgccaagtaacttcctggagatcgacatctttaatcctcagacggtgggcgtgggacgcgcgcgcttcaccacctatgaggttcgcatgcggacaaacctacctatcttcaagctaaaggagtcctgcgtacggcggcgctacagtgactttgagtggctgaaaaatgagctggagagagatagcaagattgtagtaccaccactgcctgggaaagccttgaagcggcagctccctttccgaggagatgaagggatctttgaggagtctttcatcgaagaaaggaggcagggcctcgagcagtttattaacaaaattgctgggcacccactggctcagaatgaacgctgcctacacatgttcctgcaagaggaggcaattgacaggaactacgtcccggggaaggtgcgccagtaggagcccctctcaccacctgccctctactttcctgctgaaatgacattggtttttacactaagcctctctctgtctttgatctgaagttggctgcccatctcctggcctgatagactgtctggcattgtgctccctggtacctgactacaccatgtgggcactctgctaggatcctcttctctgaggagaggtgggaacccacaggcagatgccctttgcttggggttggggtgggtgggtggggggattagactggaaggcaatttcttgggcatttacccatgccagaaggctaacctggggggaggggggcgcttgtgctggtgaggcacttggatacatactgatgctgcaagttcaggggatttttcttactcttaggtttaaccaagaacactgagcagggaaaaaccctgcctttcctaactgcatgtattttttcctttttggaaaggtggtagagactcagaagctttccttgttttcttcaggcctgctcccagttttcttaacagtttcttttgttgctttctctctcccttgttgctttccatggcagtaatcctcctagagtccaagcagtctgttgtatggagcagggtgtgtgggttttctgggcccatcattatggctgcttcagagtcagaagaaagccatagggcagtaggggagctcctattgcctagcccctctccctttgtggctcccactctagctgcctatttttgctcatcagctggtgagtcagtatgggccagcagttctccctccctaagcccttgctactttatgggttagctttgcaggtttggtggcttgaggggtgggggcaactcaccactgccaggtaactccctgaagggtgggagtggattatcttctaggctcttacccgcggtagggaagggcatcaacactgtcttccttccattctcctttcccccatcccatttagtgctgccacagggcagaagcacacaaaccaaccacacagtctctgacttctcctaagcactttgagttgttgaatggggctcaggggcaagagtttttgctgccctccccagcgtggtcacagggttattgaactgcctgcacttgtttctcatgcaactccagcattttccccagaagttgaactatggatagcagcttggtatggatttcctaaatcttaacatttgaagcagcttcttgaggctggcaactatcctggtttctgtcttggagggggtggtttgtttgctggggcccaacgtctgtcccaagtggtggggtgagagtaagttaactttggtgccaggtgagaggtgggggctctttgcttagactccctatcatggaaagattggagttttctatgcagggcactgtggaaaaggattgctgattctgactgaccctgatcagagagattaggattgtattttgacataggatttggaacccatctaaatgttgaagttccctgagacagctctccagctgctgagcctgcgccaggggctaagcagcccctaatgagaggctctgctccctttcccacctcgccaatgttgttgttgctgcctttttgatttgtatcctctgttatagacattttttaaaaacgatttcctctttcattgtgcacaagtgctgagagtctgaggccccatttctgctgtgtatatatatcctgactcggggcttttattcagcaaactgttcattcttctgtcagacaatgtcatattcaactctgttcatattaaaccactgtgaagcaaaaaaaaaaaaaaaaaa

SEQ ID NO: 334 - protein, 162 aa, Homo sapiens
MSDTAVADTRRLNSKPQDLTDAYGPPSNFLEIDIFNPQTVGVGRARFTTYEVRMRTNLPIFKLKESCVRRRYSDFEWLKNELERDSKIVVPPLPGKALKRQLPFRGDEGIFEESFIEERRQGLEQFINKIAGHPLAQNERCLHMFLQEEAIDRNYVPGKVRQ

SEQ ID NO: 335 - DNA, 6774 bp, Homo sapiens
cggcgtgagcttcggccgccattttacaacagctccactcgcgccggacacagggagcagcgagcacgcgtttcccgcaacccgataccatcggacaggatttctccgcctcagcccaacggggagggctagttgcacatagtgatttagatgaaagagctattgaagctttaaaagaattcaatgaagacggtgcattggcagttcttcaacagtttaaagacagtgatctctctcatgttcagaacaaaagtgcctttttatgtggagtcatgaagacttacaggcagagagaaaaacaagggaccaaagtagcagattctagtaaaggaccagatgaggcaaaaattaaggcactcttggaaagaacaggctacacacttgatgtgaccactggacagaggaagtatggaggaccacctccagattccgtttattcaggtcagcagccttctgttggcactgagatatttgtgggaaagatcccaagagatctatttgaggatgaacttgttccattatttgagaaagctggacctatatgggatcttcgtctaatgatggatccactcactggtctcaatagaggttatgcgtttgtcactttttgtacaaaagaagcagctcaggaggctgttaaactgtataataatcatgaaattcgttctggaaaacatattggtgtctgcatctcagttgccaacaataggctttttgtgggctctattcctaagagtaaaaccaaggaacagattcttgaagaatttagcaaagtaacagagggtcttacagacgtcattttataccaccaaccggatgacaagaaaaaaaacagaggcttttgctttcttgaatatgaagatcacaaaacagctgcccaggcaaggcgtaggttaatgagtggtaaagtcaaggtctgggggaatgttggaactgttgaatgggctgatcctatagaagatcctgatcctgaggttatggcaaaggtaaaagtgctgtttgtacgcaaccttgccaatactgtaacagaagagattttagaaaaggcatttagtcagtttgggaaactggaacgagtgaagaagttaaaagattatgcgttcattcattttgatgagcgagatggtgctgtcaaggctatggaagaaatgaatggcaaagacttggagggagaaaatattgaaattgtttttgccaagccaccagatcagaaaaggaaagaaagaaaagctcagaggcaagcagcaaaaaatcaaatgtatgacgattactactattatggtccacctcatatgccccctccaacaagaggtcgagggcgtggaggtagaggtggttatggatatcctccagattattatggatatgaagattattatgattattatggttatgattaccataactatcgtggtggatatgaagatccatactatggttatgaagattttcaagttggagctagaggaaggggtggtagaggagcaaggggtgctgctccatccagaggtcgtggggctgctcctccccgcggtagagccggttattcacagagaggaggtcctggatcagcaagaggcgttcgaggtgcgagaggaggtgcccaacaacaaagaggccgcgggcagggaaaaggggtcgaggccggtcctgacctgttacaatgaagactgacttgctatgtgggattacaccagaagcttgcagtggagtaatggtaaggaaatcaagcaaccttaaatatgtcggctgtataggagcatattctattgcagaagaccttcctatgaagatcatggaatcaaatacgggacattgaactaatacttggactttgatatgaatttctttaacaattttctctgcagtgcaagttattaaactaaagctactctattttcaaaatgtgttccaacagaaatccttcataactcctagcatggtatcttaataaagaataaagttcttttaaaaatctgctctaagtagatttttccccttttttaaattaaggatcccaacagtggtattttgaaatattctcttgaatttgtgcatttaaattttattgcagtggtatagatgaatgccactgatggtatccttaaattttatttctgctcaccaaggttaatcatgattgtctatatcttttttatagtgatcacttttgaattgtgttcagatatgcagtttcaggtgtaatcatcagagctggttagtcaggcattccagatagtggttcttttcagaacctttttaaaagggttggttaactacctcagtagcagaggattgaactataccctgtctgtactgtacatagaaaatctttgtagataaaagcaaggcttgttaaatatgatatgagggtaagattttaatataccaaatgtaacattcttagttgcctttagtttcagaggcttgtaagacttcctcatgaccatcataacaggccttgcttttgtcgtattttgtggctgaaaaagcagccttgcttcttcagatattgtagttatttggatgtataatagtttagcaagatgttacttttgtaagacatcagatgttcaaaaaagtgcatccgaacttgtactaaatactgcagtgtccctttataaaaagtcagactaaaactgacaattgtacagcgaagcctgacatttggatattttgaagttttttcataaatcatagaaattagtatatggctgtagtttagctttttaggtaaaaggtatgtttcattagtgcatttcttcctgctgatcactgtaaacatgtgaatcagctttccatttcttatgcaggtcatgataacttgtagagtagagtacaatcatttgtgctatgtttttaattttctaaagcaccttgatgacagtgagtgtccagtggtgaagcatcctctattgaaccaccctcaaaaatttttttgccaagtcctaagttgatagcttaaagtaaaaagtgaaaattatagtttcattaggacttggtgtaaagaaatcccctccccccttccccaaagggatactgcagttatatcacatacccaataggcaccacgatgaagatcagagcttatacttaattaaggttttatacacaccagttccccagtaaatgcaaatttaacaagaaaatcagacatgtcatatgttcaaaatgctcatggcaaacaatcattttgcattcctgcaaataaaattgttttatactgtaagctggaggcgagtgtaacttatttttgtaataaagtttttattttttttatgtgtcattaatataaatgtgtgttagtgtagaaatcttctggtttaaaaacttagaattgcacacatttcagtatgtttatttgtacttacataattttagaatagtggttgccaatagcctgtatgtttcacattaattggttttttgttatctaaataaatcattttagtatgttgtatgtcagttactgggatagctgggacatagagtgtaatttaaaatttgtcaataagtattcattggaatatatgtaaatgtgccttgccggttattgaaacttatctacaaaatgagtatggggtgacaaaaattagttcctggtgcttaatgaaactttctgccactgattttatatattaccccgtgcttttttaaagtacatctctctcaaaacttagtgtaagtttgagggctacacaaaacatttacatttcattctaacataatgaatataataggttgtggaaagtgggtaaactaaatgtagccttcagtaaaattgaatctcagtgtaatccttggtgctggcatttctcagttccgaggagttaaatgatcccatctaagaggtcattgccatgcctattggcactttactgtcatagcatttttaagggacactgtcaaggtgtttaagttctcagaattacttgttgggattttaggacaggtttgtttacttaaagtaagaactgcattgtcaaagttgaaagaggaacacttttgtgagttcacaaatgtgttcttaagaaaacattaaaatatggagctctgggttttcaagactatttggcattcttaatttggggacttgggagggaaactgataaaaagaaattgaagaattgatggttatacttaaagaagggtaatgtaaacagtggtgatgaaatatatacacatcaagtgaaattacttgacagtgttcatttgaatgactttgaattcaagccattataattacttttaaaattaaatatcatttgcactgttctgataatgggtgcagtttttgagcaatataatcagagctaaatatgcatgtagtgattagtgatgtgaacaattaacgttctgagaagaaatactaactgtggtattttcaaacttaaatttctgtagtaaaatcagtatcaaagtcttatcagatcaaggaaaaacaggcaatgcatataaacatacttttgaatgttgtgtggcctataaagcaataatgcaatttatatggaatgtcatgggatatgagaaatggaaatgcaaaaataactaatcctttagtaaaaatgtcaacatgttaaagggggaatgttaactaatgtaggttattgctatttgtgatttgtttatgggttcttggctttgacagcttcaaagaatggacagtgataagttaaaagaaattttgtatattgtcaaggaaagggtcttaaatccgagtcaagtcccttccttggggtaaaaaatgtattcttaaagcattctgatgttaaaaagaaaacttaagttatctaaccaaaacagacgcaagattttgtttctgcagactacttggcaatcaaaagtgatcataaatttaggttatcagttttcagaaagttgctttgtgagaaaattttgttagatatattctcccaagcatgctttttgtggaaggttttcagccattgccactgaatcagatgttaaaaatgaagggaaaattgagtgtgcacacacacaactgttgtacactcatgattgcagtttttagcttaagaaacttttctaccagttactgtgaatctgacttaaaatgtaaagtttcctcatgataaaataggaacaacatagaaatggattgatggggtgatctgagttattgtatataaaagtttttaaagaatagaatgaacatcaagctagataggcaaaaattgacacattcagaacagcttttttgactgcgaagccaaaagttgtcagaaacagcaaaagatcccttattattacagagtattttacgtagtctctattttaaggagagaaattaaatagaagggcttcatgcatttaggggagggtgctaaaacttctcaagttcgtcaaacttacaggaatacccaccatgatcattttctctctaattatgtataccacaaaattttcatctggccataggaattcactggtgggtgtaaaattaatgactaaagaaattaagtgacaaatacataaaagaaacagacttgtggggatattgttttaaggtgtattaattactcagtgatgataccactcaatagggcatgccactacttttcttaagatgctaattatgaagcagtgctcacaggcattttttaactagcaaattagtagatggacttttggggtctgtcactttttaaaagtatttaagacttaaattctattagcaccacagtctgccttcagtaatacacctaaaatatttttcaggaccagaagcattcagtttgaaaatttgcagatgcaaaccagtattattactaacgctctgggtcaaagattaggtttttaatattaacagtagtctggtaaatatttagaagtctggcattgagaaacaaaagcttgtacctgactagtatttttatttaaaaaaattagttctgttagcttatttaaattgtgttttatttatccgtagaatttatatttatttcattcctttcatctcactgaaaactgtctgcaggccctttgatttggattagatgtgtgaagtactgtcttttgccaaaaacctcaaattacctgttcttttcaacgtagtgggtttgtgcttgtttggagatcagttcaaaaactatctgtactatctgtactgcctctgatgttaagattttatgtatagcataaggaagctagctctgactatattttcctaagaataaagacctatttttgtagcatgtcttaggatctccaggagtccaagaattattgtgggtgtcctccaattcatcactcttcacttaacagcttttaagtagacacttggaatctttagaggtctgtcgccctttgattatccatacattcgaagtaactagccaatggtgaaaaattcctcaagatatcctcagttgcaatcacattactggaagatgaatagaataaatgtattaggctggtcttaatttttgatggaaatattctgttgtcccgtacttgccattggatttgataaagttagtggtaatttggaaagaatcggggacttgccaatatatttgtgggttttagcttatacccctaggatttcttggttgcgggacgagcagttttggccacttccatcaggacaagactttttaggtcacttagtgcaggttttagtttctattttggattaacaacatttatattgattatcgaaaagaagctttcatcatttcagaacagtcctggaagtttgactttgagtgtgggagaagtcctaataaaccattttggaaattaaaaaaaaaa

SEQ ID NO: 336 - protein, 464 aa, Homo sapiens
MKTYRQREKQGTKVADSSKGPDEAKIKALLERTGYTLDVTTGQRKYGGPPPDSVYSGQQPSVGTEIFVGKIPRDLFEDELVPLFEKAGPIWDLRLMMDPLTGLNRGYAFVTFCTKEAAQEAVKLYNNHEIRSGKHIGVCISVANNRLFVGSIPKSKTKEQILEEFSKVTEGLTDVILYHQPDDKKKNRGFCFLEYEDHKTAAQARRRLMSGKVKVWGNVGTVEWADPIEDPDPEVMAKVKVLFVRNLANTVTEEILEKAFSQFGKLERVKKLKDYAFIHFDERDGAVKAMEEMNGKDLEGENIEIVFAKPPDQKRKERKAQRQAAKNQMYDDYYYYGPPHMPPPTRGRGRGGRGGYGYPPDYYGYEDYYDYYGYDYHNYRGGYEDPYYGYEDFQVGARGRGGRGARGAAPSRGRGAAPPRGRAGYSQRGGPGSARGVRGARGGAQQQRGRGQGKGVEAGPDLLQ

SEQ ID NO: 337 - DNA, 6651 bp, Homo sapiens
gccggcccggaaggggctgatgcgaactggggccacggcagccatcgcgctttgcagttcggtctcctggtgtacggccaacgccaagtaggggattgcgttccctccagtcgcagagtttccctcttgtcgcccaggctggagtgaagtggcacgatctcggcttactgcaagctccgcctcccgggttcacgccattctcctgcctcagcctcccgagtagctgggactacagaccctatcagatttggatatgtccttcatatttgattggatttacagtggtttcagcagtgtgctacagtttttaggattatataagaaaactggtaaactggtatttcttggattggataatgcaggaaaaacaacattgctacacatgctaaaagatgacagacttggacaacatgtcccaacattacatcccacttccgaagaactgaccattgctggcatgacgtttacaacttttgatctgggtggacatgttcaagctcgaagagtgtggaaaaactaccttcctgctatcaatggcattgtatttctggtggattgtgcagaccacgaaaggctgttagagtcaaaagaagaacttgattcactaatgacagatgaaaccattgctaatgtgcctatactgattcttgggaataagatcgacagacctgaagccatcagtgaagagaggttgcgagagatgtttggtttatatggtcagacaacaggaaaggggagtatatctctgaaagaactgaatgcccgacccttagaagttttcatgtgtagtgtgctcaaaagacaaggttacggagaaggcttccgctggatggcacagtacattgattaacacaaactcacattggttccaggtctcaacgttcaggcttactcagagatttgattgctcaacatgcataacttgaattcaatagacttttgctggttataaaacagatgttttttagattattaatattaaatcaacttaatttgaatgagaattgaaaactgattcaagtaagtttgagtatcacaatgttagctttctaattccataaaagtacttggtttttacagtttataatctgacatcaccccagcgccatttgtaaagagcaactttccagcagtacatttgaagcactttttaacaacatgaaactataaaccatatttaaaagctcatcatgttaaattttttatgtacttttctggaactagtttttaaattttagattatatgtccacctatcttaagtgtacagttaataattagcttattcaatgattgcatgatgccttacagttttcaataactttttttcttatgcaaacgtcatgcaataaaacaaactctaatgtttggcatccttgttgggcaaatgtttcatttaaatgtgtcttatctagctagtatactctgaaaatttgagtatttaatattaggcatatgaagtggttgttgggaaaggagattccttcagaatatttagaatagcgtttaaggctctcaaggcttaggtatttaccatgagatggttgtggtcagttgcacctgataccatgtatccctgaatcatgtgtatttttattagtaatgcagccactaccattgctgatggggtctgtgtcctagtccctgtgggattggccttctgaagaaaagcacatttatggtacacaaggttgattctcagtttggtaggctctatagttccatcccagctgtctaattctgaagtgctccagtcttattggtgcccaatggggtaatctgtgcctcttccccaaaagcaatgacaggcaccagtgtctccacatttagatatattcccagtctctgtacatttaacagtactctctggggcaagcaataagtaggaccttgtgtgcagtttcattgtagagacatgtatatctgaggaataaaacagcttgttctgtgtcagtctgagatatgtggagattttgttcctatcctatagctcttttgtattctttggcatattttatatcctggtagaagaaaacaagtgcttgtttccaattttcttttttcttatttgctctcaggtagttcttactccatacaacaaagactttttgtttgttgggctttttttttttttttttttttgctctgtttcattttgttttagagacggggtttcaccatgttgtccaggctggtctcaaactcctgacctcaagtgatctgcccgccttggcctcccaaagttctgggattataggcgtgagctaccatgcctgacctgacttttgtttttagatattatgcttgccatgtgatagggcctgcaagcctcattgctaggcttactaagaaaattttagtttttcaaaagcattataatttcctaagaaactgaattctttttttatatgtttgagattcccatcattagtaatataagatgaaaggtaagtgccaaaaatgtatttttaaagaccctcaagtttaagatttatcctgattataagccaagttttatagtatatttaaccaattccatcaagaataattttaatatcaaaaattagtgttttctgtagccattgtccatgtcagagttacagtcctttttgtcattgataatataacctatgaagcagataaggattgaggaatatgactggaaggaattactatttagctaagctgacaaggtcgcttcttaagatgacatttggtttcagtaatctgactattctgttttcactttcatcttctttctaaatgaaaacaaaagtgctccctcccttcctggaaacctcagtaacactatgggaaaagtagaacatgacattgcagcctattgatttcttcttccagataggtttaaagtactccttaagttctgactaaatagaactaagccttattaaaaataactgcctcttgttcatgttatctgtaccttcagggacctgcctttcttcaagtatttcctagagtatctattatgatactgaagaagctaattatttgtgttgtaaatgggtataaatgaaaaaaaaacatactggtttctctagccaggaaaaatgctttctggtgtaatatatcttgctccagaaccctcattctaattgtaacactaggatcaaagaaacaaagtcactttgtggaccacagctaaactgtggatattttcccaaagacataagatttttatggcccgagcctctagaaaggaagccatgtttaggagcaaccagctttcctcccagctttagggggcagagttcctgagccagaggacttactgtccagctttgagaacctctccagagtatatgcactgggtactgctctttttcaagagaaccaaattaagaggatggcaagaaacagtagaagcacagaggaaagacaactctgcatgtgcctgtgtgaatgtgtgcatccatggagtatttcccaggtaaatactagtactggggacataggctaattgtgtgtcccacactgcaagatgctagggcgtagttaacactgtggtatacatacaaatcaggcactgtccaaaagattttttaaaatctaaagtctgaaatgtaaaaatataaggtctcaacccacttttacacttttaaagagatcccatacctgtttcactgactgccgttaattacacttttggatcacagctggttaaattgatagatttcagtttatctcagtgaatttttagaatggagattatagcattttttaattggagaacagacatttcctaaagtatatgaaaaaaaattattcactgttggtttaaaccagtatctttgtatgagtgccaaagatatatgaacacagatactgcctgtgcagacctaaattttagttttgtgtacctggatccatatacaaattttttgtggtttatagcataaaagcagaacgttgtttctttcttagttttcaaccggctcatcttttgtttttgttttttgtttttttgttttttgttttttttgagatggagtcttgctttgttgcccaggctagagtgcagtggcacaatctctgcttactgcaacctccacctccggggttcaagtgattctcctgcctcagcctcctgagtagctgggactacaggcgcgcaccaccatgcccggctaatttttgtatttttagtagagatggggtttcactatgttggccaggctggtctcgaactcctgacctcgtgatctgcccacctcagcctcccaaagtgctgggattacaggcgtgagccgccatgcccggccaattttcaactggcccatactttatagtgatggaaagcgcataaactacttgtaaatcattaaaatagggtgataactgtgataatagtgtttcttgcattctagaaaattattttattaactacattcaaaacccagcatttcacaggttccatcattagaaacagtatagttctagttaacatgattggagagtttcaggggaaaggtttacattttctgaaactgtatttggtatgtgactcaatgtggtatttcagtcttgttagtcacttacatgactgacgtttgcaaggatttattgccaagtaaaatttgaccagagtgcactgagaatagctacataaggggaaatctctcaaaattccttctgttcatttaatttggagcatattgtttaaatcattttaaacatatgtaaaaagttgaagcattaaaaaatcttcaagaaacaatgaaaaaatagaaattagcaaacataagtttcttaatgcaaaattaatagtgaataaaatatagcctacattaaaagccagaggctttgctataaatataagagtttagaaaaacagtgtgcttcaattaaggactaaattatcaaaactgcatgtttgttttttcttttcttttcttttttttttgagatgaagtctcactctgttgcccaggctggagtgcagtggtgcgatcttggctcactgcaacctctgcttcccaggttcaagcgattctcgtgcctcaccatcccgagtagctgggattacaggtgcaccacaccatgcccagttaatttttgtatttttagtagagacagggtttcattatttggccaggctggtctcgagctcctgatcttaagtgatccactcgcctcggcctcccaaagtgctgggattatacacatgagccactgtgcccagcctaaaactacatgttgaagcttccggtcatttccattattatccttcttttgaaattcaagttagtgctttttaaccaaataaaagaagaaccagctcttgggatatgtgactctgcctctgtataaagtgactggaattttgttaaaaccgtgtttccacttctgaaccctgttaccattccccctcacaaatccccacccaacacctggattttaaagatcctccagtgtcaagggaagccacagagtctattaaagaggcagttctgaaccaattaatttttgtccttataatttagagcattaaatagctaatatatttaatggcactaattgttgttcacggctttcatcatacttttaaacagaatccaaagtattcaaaggaaagtaagcgaagttatccaaagccaactttgtttcaggtgtgtcccctgccccaaatagattttagggcagaaatagaaaactgagtttacacagaactatttttggaaaagctgcactggagtagatggattcttcttcagcatacttttttgtttgtttgtttgagatggagtcttgctttgtcacccaggctggagtgcagtggtgtgatctccactcactgcaacctccacctcccagcttcaagtgattctcctgcctcaaccttccaagtagcttggattacaggcgtgcgccaccacagctggctaatatttgtattgttagtagagacagggtttcaccatgttgtccaggcttgtcgaacttctgacctcacgtgatccacctgcctcagcctcccaaagtgctagattataggcgtgaaccactgcgcccggccagcatgcattttaaaagtggcttagatttagttttaaatattttggggtgaaaggcaggaacagttctgtttttgacatacaggttttctttgggattgttttcattttcaagtatagattcatgtcagaatggccaacttaacgtgggtttctgtattccctggtgttgctcttaacctgaactcataatcagttgccatactgaggcaagagcactcagggtgaacatagtcaagttactttaaaagtgataaaagtgtttttccatggtgaaaccttcagtatttggctgaatgtaaagtatgttgaagtggtatattgatggtaagttgttaatcactaaccttgtttgcacttttgtacaccactgcttgcactaggatcttggtgtgaattttcaattgttttacagtgtatacagattattaaggataatttatataaagatgtttctgtttaactttgtgtgttttacaacaaagagctataatagatggttaaacgtttttgaattgtgtttatatgttagtttgattatgttctattatcttttcacctgccatgaatttgagtgttaggaagggaaaaataaaatactaatctggtcttgaagaa

SEQ ID NO: 338 - protein, 198 aa, Homo sapiens
MSFIFDWIYSGFSSVLQFLGLYKKTGKLVFLGLDNAGKTTLLHMLKDDRLGQHVPTLHPTSEELTIAGMTFTTFDLGGHVQARRVWKNYLPAINGIVFLVDCADHERLLESKEELDSLMTDETIANVPILILGNKIDRPEAISEERLREMFGLYGQTTGKGSISLKELNARPLEVFMCSVLKRQGYGEGFRWMAQYID

SEQ ID NO: 339 - DNA, 3445 bp, Homo sapiens
attatgtaattttcccaaaagccccacctcgcctcagccgggcgggagagagggaggtctcgcgctttccccggggttgcgtcccgccccgcaggctgcgcgcaggcgctgacgagccgctcgcattctacgtaacggacggcggaggctacgtgaagagaggcgcggcgtgactgagctacggttctggctgcgtcctagaggcatccggggcagtaaaaccgctgcgatcgcggaggcggcggccaggccgagaggcaggccgggcaggggtgtcggacgcagggcgctgggccgggtttcggcttcggccacagctttttttctcaaggtgcaatgaaagccttccacactttctgtgttgtccttctggtgtttgggagtgtctctgaagccaagtttgatgattttgaggatgaggaggacatagtagagtatgatgataatgacttcgctgaatttgaggatgtcatggaagactctgttactgaatctcctcaacgggtcataatcactgaagatgatgaagatgagaccactgtggagttggaagggcaggatgaaaaccaagaaggagattttgaagatgcagatacccaggagggagatactgagagtgaaccatatgatgatgaagaatttgaaggttatgaagacaaaccagatacttcttctagcaaaaataaagacccaataacgattgttgatgttcctgcacacctccagaacagctgggagagttattatctagaaattttgatggtgactggtctgcttgcttatatcatgaattacatcattgggaagaataaaaacagtcgccttgcacaggcctggtttaacactcatagggagcttttggagagcaactttactttagtgggggatgatggaactaacaaagaagccacaagcacaggaaagttgaaccaggagaatgagcacatctataacctgtggtgttctggtcgagtgtgctgtgagggcatgcttatccagctgaggttcctcaagagacaagacttactgaatgtcctggcccggatgatgaggccagtgagtgatcaagtgcaaataaaagtaaccatgaatgatgaagacatggatacctacgtatttgctgttggcacacggaaagccttggtgcgactacagaaagagatgcaggatttgagtgagttttgtagtgataaacctaagtctggagcaaagtatggactgccggactctttggccatcctgtcagagatgggagaagtcacagacggaatgatggatacaaagatggttcactttcttacacactatgctgacaagattgaatctgttcatttttcagaccagttctctggtccaaaaattatgcaagaggaaggtcagcctttaaagctacctgacactaagaggacactgttgtttacatttaatgtgcctggctcaggtaacacttacccaaaggatatggaggcactgctacccctgatgaacatggtgatttattctattgataaagccaaaaagttccgactcaacagagaaggcaaacaaaaagcagataagaaccgtgcccgagtagaagagaacttcttgaaactgacacatgtgcaaagacaggaagcagcacagtctcggcgggaggagaaaaaaagagcagagaaggagcgaatcatgaatgaggaagatcctgagaaacagcgcaggctggaggaggctgcattgaggcgtgagcaaaagaagttggaaaagaagcaaatgaaaatgaaacaaatcaaagtgaaagccatgtaaagccatcccagagatttgagttctgatgccacctgtaagctctgaattcacaggaaacatgaaaaacgccagtccatttctcaaccttaaatttcagacagtcttgggcaactgagaaatccttatttcatcatctactctgtttggggtttggggttttacagagattgaagatacctggaaagggctctgtttcaagaatttttttttccagataatcaaattattttgattattttataaaaggaatgatctatgaaatctgtgtaggttttaaatattttaaaaattataatacaaatcatcagtgcttttagtacttcagtgtttaaagaaataccgtgaaatttataggtagataaccagattgttgctttttgtttaaaccaagcagttgaaatggctataaagactgactctaaaccaagattctgcaaataatgattggaattgcacaataaacattgcttgatgttttcttgtatgtctacattaaacttgagaaaaagtaaaaattagaacactgtatgtagtaatgaaatttcagggacccagaacataatgtagtatatgtttttaggtgggagatgctgataacaaaattaataggaagtctgtaggcattaggatactgacatgtacatggaaaattctagggacaggagcatcattttttccttacctgataccacgaaccagtgacaacgtgaatgctgtattttaagtggttgtatgtttattttcttgagtaacaaatgcatgaaaaattaatgcttcacctaggtaagatcattggtctgtgtgaaatcacaaatgttttttccttcttggttgctgcagcctggtggatgttcatggagaagctctgttctctatattatggctgtgtgccgttgcttctccctctgcttttatcttttccacagttgaggctgggtatgttctttcaaagaaatggccatgaatatgtgtaagtatacttttgaaaatgagctttcctaaactattgagagttctttccacctcttgcggaaccaactcttggaggagaggcccatgtatctgcacgagcacttagcttgttcagatctctgcattttataaatgcttcttaccaagaaagcatttttaggtcattgcttgtaccaggtaatttttgccggggatgggtaagggttgggttttctggtgggagtggggtggtgggtattttttgttgatgctttagtgcaggcctgttctgaggcaataacaagttgctgtgaaaacagcatgtgctgctgcctttgtaactgcatggaaacttttcacatgggtttttctccaagttaatacagaaatatgtaaactgagagatgcaaatgtaatatttttaacagttcatgaagttgttattaaaataactaacataaaacttaattactttaatattatataattatagtagtggccttgttttacaaacctttaaattacattttagaaatcaaagttgatagtcttagttatcttttgagtaagaaaagctttcctaaagtcccatacatttggaccatggcagctaattttgtaacttaagcattcatatgaactacctatggacatctattaaagtgattgacaaaatctcaaaaaaaaaaaaaaaaaaaaaaaaaaa

SEQ ID NO: 340 - protein, 483 aa, Homo sapiens
MKAFHTFCVVLLVFGSVSEAKFDDFEDEEDIVEYDDNDFAEFEDVMEDSVTESPQRVIITEDDEDETTVELEGQDENQEGDFEDADTQEGDTESEPYDDEEFEGYEDKPDTSSSKNKDPITIVDVPAHLQNSWESYYLEILMVTGLLAYIMNYIIGKNKNSRLAQAWFNTHRELLESNFTLVGDDGTNKEATSTGKLNQENEHIYNLWCSGRVCCEGMLIQLRFLKRQDLLNVLARMMRPVSDQVQIKVTMNDEDMDTYVFAVGTRKALVRLQKEMQDLSEFCSDKPKSGAKYGLPDSLAILSEMGEVTDGMMDTKMVHFLTHYADKIESVHFSDQFSGPKIMQEEGQPLKLPDTKRTLLFTFNVPGSGNTYPKDMEALLPLMNMVIYSIDKAKKFRLNREGKQKADKNRARVEENFLKLTHVQRQEAAQSRREEKKRAEKERIMNEEDPEKQRRLEEAALRREQKKLEKKQMKMKQIKVKAM

SEQ ID NO: 341 - DNA, 1814 bp, Homo sapiens
ctgagcgggtgcgcgggcaacttccggtgtgggtgacgagtggtggccgaagcagggggacagcaagggacgctcaggcggggaccatggcggacggcggctcggagcgggctgacgggcgcatcgtcaagatggaggtggactacagcgccacggtggatcagcgcctacccgagtgtgcgaagctagccaaggaaggaagacttcaagaagtcattgaaacccttctctctctggaaaagcagactcgtactgcttccgatatggtatcgacatcccgtatcttagttgcagtagtgaagatgtgctatgaggctaaagaatgggatttacttaatgaaaatattatgcttttgtccaaaaggcggagtcagttaaaacaagctgttgccaaaatggttcaacagtgctgtacttatgttgaggaaatcacagaccttcctatcaaacttcgattaattgatactctacgaatggttaccgaaggcaagatttatgttgaaattgagcgtgcgcgactgactaaaacattagcaactataaaagaacaaaatggtgatgtgaaagaggcagcctccattttacaggagttacaggtggaaacctacgggtcaatggaaaagaaagagcgagtggaatttattttggagcaaatgaggctctgcctagctgtgaaggattacattcgaacacaaatcatcagcaagaaaattaacaccaaatttttccaggaagaaaatacagagaaattaaagttgaagtactataatttaatgattcagctggatcaacatgagggatcctatttgtctatttgtaagcactacagagcaatatatgatactccctgtatacaggcagaaagtgaaaaatggcagcaggctctgaagagtgttgtactctatgttatcctggctccttttgacaatgaacagtcagatttggttcaccgaataagtggtgacaagaagttagaagaaattcccaaatacaaggatcttttaaagctttttaccacaatggagttgatgcgttggtccacacttgttgaggactatggaatggaattaagaaaaggttcccttgagagtcctgcaacggatgtttttggttctacagaggaaggtgaaaaaaggtggaaagacttgaagaacagagttgttgaacataatattagaataatggccaagtattatactcggataacaatgaaaaggatggcacagcttctggatctatctgttgatgagtccgaagcctttctctcaaatctagtagttaacaagaccatctttgctaaagtagacagattagcaggaattatcaacttccagagacccaaggatccaaataatttattaaatgactggtctcagaaactgaactcattaatgtctctggttaacaaaactacgcatctcatagccaaagaggagatgatacataatctacaataagggtcttagtgctttagaaaaaagttaaaattggaagtcattaaaaaaagactgttataatggtgtatatgttggggttttttttctaagcttctttgtcttaaattttaaaatagtgaatatgtttgagactccctttgacctttcagttccccaagttcattgttaactttgcatttgcaattggtgcaaaaatacagatttctgtcgtctgaatacacaaaaagttgtgtcataacttacccagatatgtttttctatcatttgaaacctttttagctactgtttgttttcattcaactaacaaacatattccaataataaaagcagtatatacataaaaaaaaaaaaaaaaaa

SEQ ID NO: 342 - protein, 456 aa, Homo sapiens
MADGGSERADGRIVKMEVDYSATVDQRLPECAKLAKEGRLQEVIETLLSLEKQTRTASDMVSTSRILVAVVKMCYEAKEWDLLNENIMLLSKRRSQLKQAVAKMVQQCCTYVEEITDLPIKLRLIDTLRMVTEGKIYVEIERARLTKTLATIKEQNGDVKEAASILQELQVETYGSMEKKERVEFILEQMRLCLAVKDYIRTQIISKKINTKFFQEENTEKLKLKYYNLMIQLDQHEGSYLSICKHYRAIYDTPCIQAESEKWQQALKSVVLYVILAPFDNEQSDLVHRISGDKKLEEIPKYKDLLKLFTTMELMRWSTLVEDYGMELRKGSLESPATDVFGSTEEGEKRWKDLKNRVVEHNIRIMAKYYTRITMKRMAQLLDLSVDESEAFLSNLVVNKTIFAKVDRLAGIINFQRPKDPNNLLNDWSQKLNSLMSLVNKTTHLIAKEEMIHNLQ

SEQ ID NO: 343 - DNA, 2116 bp, Homo sapiens
actcccgggccgccgggggcactagggggggtggggtttccttccgcatctccacggttccaactccaacctagactcaaactggacgccggccggagactccgctccggcagcaaaccccacgtggtgcacctctgagcctccgcccctctcccgagggaaccgcaactctacttctcgcgagaattgcttctatggctccatcctgctttccggctgtcgccctcatgcgataggctctcagcgttacttgactcttctcgcgataattttttttaaaaatctcccaaggaaagttgaaggaagagtacaaaattttcatctcgcgagacttgtgagcggccatcttggtcctgccctgacagattctcctatcggggtcacagggacgctaagattgctacctggactttcgttgaccatgctgtcccgggtggtactttccgccgccgccacagcggccccctctctgaagaatgcagccttcctaggtccaggggtattgcaggcaacaaggacctttcatacagggcagccacaccttgtccctgtaccacctcttcctgaatacggaggaaaagttcgttatggactgatccctgaggaattcttccagtttctttatcctaaaactggtgtaacaggaccctatgtactcggaactgggcttatcttgtacgctttatccaaagaaatatatgtgattagcgcagagaccttcactgccctatcagtactaggtgtaatggtctatggaattaaaaaatatggtccctttgttgcagactttgctgataaactcaatgagcaaaaacttgcccaactagaagaggcgaagcaggcttccatccaacacatccagaatgcaattgatacggagaagtcacaacaggcactggttcagaagcgccattacctttttgatgtgcaaaggaataacattgctatggctttggaagttacttaccgggaacgactgtatagagtatataaggaagtaaagaatcgcctggactatcatatatctgtgcagaacatgatgcgtcgaaaggaacaagaacacatgataaattgggtggagaagcacgtggtgcaaagcatctccacacagcaggaaaaggagacaattgccaagtgcattgcggacctaaagctgctggcaaagaaggctcaagcacagccagttatgtaaatgtatctatcccaattgagacagctagaaacagttgactgactaaatggaaactagtctatttgacaaagtctttctgtgttggtgtctactgaagttatagtttacccttcctaaaaatgaaaagtttgtttcatatagtgagagaacgaaatctctatcggccagtcagatgtttctcatccttcttgctctgcctttgagttgttccgtgatcacttctgaataagcagtttgcctttataaaaacttgctgcctgactaaagattaacaggttatagtttaaatttgtaattaattctaccatcttgcaataaagtgacaattgaatgaaacagggtttttcaagttgtataattctctgaaatactcagcttttgtcatatgggtaaaaattaaagatgtcattgaactactgtcttgtttatgagaccattcagtggtgaactgtttctggctgataggttatgagatatgtaaagctttctagtactcttaaaataactaaatggagtattatatatcaattcatatcattgactttattattttagtagtatgcctatagaaaatattatggactcagagtgtcataaaatcactcttaagaatccatgcagcaggccaggcacagtggctcacacctgtaatgcctgcactttggaaggccgagacaggcggatcacttgaggtcaggagtttgaaaccagccaggccaacacagtgaaaccctgtctctactaaaaatacaaaaggttagccgggcatggtggcaggcgcctgtaatcccagctactcaggaggctgaggcaggagaattgcttgaacgcaggaggcaaaggttgcagtgagctgagatcacgccactgcactccagcctgggcaacagacctcgactccatctagaaaaaaaaaaaaaaaaa

SEQ ID NO: 344 - protein, 256 aa, Homo sapiens
MLSRVVLSAAATAAPSLKNAAFLGPGVLQATRTFHTGQPHLVPVPPLPEYGGKVRYGLIPEEFFQFLYPKTGVTGPYVLGTGLILYALSKEIYVISAETFTALSVLGVMVYGIKKYGPFVADFADKLNEQKLAQLEEAKQASIQHIQNAIDTEKSQQALVQKRHYLFDVQRNNIAMALEVTYRERLYRVYKEVKNRLDYHISVQNMMRRKEQEHMINWVEKHVVQSISTQQEKETIAKCIADLKLLAKKAQAQPVM

SEQ ID NO: 345 - DNA, 2956 bp, Homo sapiens
gacagggccgcggacgcccgggcagccacggcggcggggccgcggcgggcgccggctcagcccgcccctttctcccgccgcctccccgccccgccccgcgccgcgccggccgctgtcagctccctcagcgtccggccgaggcgcggtgtatgctgagccgctgccgcagcgggctgctccacgtcctgggccttagcttcctgctgcagacccgccggccgattctcctctgctctccacgtctcatgaagccgctggtcgtgttcgtcctcggcggccccggcgccggcaaggggacccagtgcgcccgcatcgtcgagaaatatggctacacacacctttctgcaggagagctgcttcgtgatgaaaggaagaacccagattcacagtatggtgaacttattgaaaagtacattaaagaaggaaagattgtaccagttgagataaccatcagtttattaaagagggaaatggatcagacaatggctgccaatgctcagaagaataaattcttgattgatgggtttccaagaaatcaagacaaccttcaaggatggaacaagaccatggatgggaaggcagatgtatctttcgttctcttttttgactgtaataatgagatttgtattgaacgatgtcttgagaggggaaagagtagtggtaggagtgatgacaacagagagagcttggaaaagagaattcagacctaccttcagtcaacaaagccaattattgacttatatgaagaaatggggaaagtcaagaaaatagatgcttctaaatctgttgatgaagtttttgatgaagttgtgcagatttttgacaaggaaggctaattctaaacctgaaggcatccttgaaatcatgcttgaatattgctttgatagctgctatcatgacccctttttaaggcaattctaatctttcataactacatctcaattagtggctggaaagtacatggtaaaacaaagtaaatttttttatgttcttttttttggtcacaggagtagacagtgaattcaggtttaacttcaccttagttatggtgctcaccaaacgaagggtatcagctattttttttaaaattcaaaaagaatatcccttttatagtttgtgccttctgtgagcaaaactttttagtacgcgtatatatccctctagtaatcacaacattttaggatttagggatacccgcttcctctttttcttgcaagttttaaatttccaaccttaagtgaatttgtggaccaaatttcaaaggaactttttgtgtagtcagttcttgcacaatgtgtttggtaaacaaactcaaaatggattcttaggagcattttagtgtttattaaataactgaccatttgctgtagaaagatgagaaaacttaagctttgttttactacaacttgtacaaagttgtatgacagggcatattctttgcttccaagatttgggttgggggcactaggggttcagagcctggcagaattgtcagctttagtctgacataatctaagggtatggggcaaggatcacatctaatgcttgtgttccttatactctattatatagtgttattcatgattcagctgatcttaacaaaattcgtagcagtggaaccttgaaatgcatgtggctagatttatgctaaaatgattctcagttagcattttagtaacacttcaaaggtttttttttgtttgttttctagacttaataaaagcttaggattaattagaagaagcaatctagttaaatttcccatttgtattttattttcttgaatacttttttcatagttatttgtttaaaaagatttaaaaatcattgcactttggtcagaaaaataataaatatatcttataaatgtttgattcccttccttgctatttttattcagtagatttttgtttggcatcatgttgaagcaccgaaagataaatgatttttaaaaggctatagagtccaaaggaatattcttttacaccaattcttcctttaaaaatctctgaggaatttgttttcgccttacttttttttcttctgtcacaatgctaagtggtatccgaggttcttaatatgagatttaaaatcttaaaatgtttcttattttcagcacttacatcatttggtacacagggtcaaatagggcaaataattttgtctttgtataatagatttgatatttaaagtcactggaaataggacaagttaatggatgtttttatattttaatagaatcatttatttctatgtgttatgaaattcacttaatgataaatttttcaacatacttgccattagaaaacaaagtattgctaagtactataacatattggccactaaaattcatattgagattatcttggtttcttggaagagataggaatgagttcttatctagtgttgcaggccagcaaatacagaggtggtttaatcaaacagctctagtatgaagcaagagtaaagactaaggtttcgagagcattcctactcacataagtgaagaaatctgtcagataggaatctaaatatttatagtgagattgtgaaagcaaccttaaagttttgaagaagactgatgagactaggtgctttgcttcctttcatcaggtatctttctgtggcatttgagaacagaaaccaagaaacatggtaattactaaattatgaggctttgctttttgtttgcttttaagtagaaaaacatgttggcaacattgagttttggagttgattgagataatatgacttaactagttttgtcattccatttgttaaagatacagtcaccaagaatgttttgagttttttgaaagaccccaatttaagccttgcttatttttaaattatttccattcagtgatgttggatgtatatcagttatttagtaaataatctcaataaattttgtgctgtggcctttgctaaaaaaaaaaaaaaaaaaaaaaaaaaa

SEQ ID NO: 346 - protein, 228 aa, Homo sapiens
MLSRCRSGLLHVLGLSFLLQTRRPILLCSPRLMKPLVVFVLGGPGAGKGTQCARIVEKYGYTHLSAGELLRDERKNPDSQYGELIEKYIKEGKIVPVEITISLLKREMDQTMAANAQKNKFLIDGFPRNQDNLQGWNKTMDGKADVSFVLFFDCNNEICIERCLERGKSSGRSDDNRESLEKRIQTYLQSTKPIIDLYEEMGKVKKIDASKSVDEVFDEVVQIFDKEG

SEQ ID NO: 347 - DNA, 590 bp, Homo sapiens
tgggcgtggcttgaatgacttcagtggcctcctcctgggagggagctgaagccgctcgcaagactcccgtagtccccacctctctcagcttccggctggtagtagttccgcttcctgtccgactgtggtgtctttgctgagggtcacattgagctgcaggttgaatccggggtgcctttaggattcagcaccatggcggaagacatggagaccaaaatcaagaactacaagaccgccccttttgacagccgcttccccaaccagaaccagactagaaactgctggcagaactacctggacttccaccgctgtcagaaggcaatgaccgctaaaggaggcgatatctctgtgtgcgaatggtaccagcgtgtgtaccagtccctctgccccacatcctgggtcacagactgggatgagcaacgggctgaaggcacgtttcccgggaagatctgaactggctgcatctccctttcctctgtcctccatccttctcccaggatggtgaagggggacctggtacccagtgatccccaccccaggatcctaaatcatgacttacctgctaataaaaactcattggaaaagtgaga

SEQ ID NO: 348 - protein, 86 aa, Homo sapiens
MAEDMETKIKNYKTAPFDSRFPNQNQTRNCWQNYLDFHRCQKAMTAKGGDISVCEWYQRVYQSLCPTSWVTDWDEQRAEGTFPGKI

SEQ ID NO: 349 - DNA, 2254 bp, Homo sapiens
agagtgcacccgaatccacgggctcggaggcagcagccatctctcggccatagggcaggccagctggcgccgggggctattttgggcggcgggcaatgatggtgaccgcaaggcgaccttgtaaggcatttcccccctgactcccttccccgagcctctgcccgggggtcctagcgccgctttctcagccatcccgcctacaacttagccgtccacaacaggatcatctgatcgcgtgcgcccgggctacgatctgcgaggcccgcggaccttgacccggcattgaccgccaccgccccccaggtccgtagggaccaaagaaggggcgggaggaagactgtcacgtggcgccggagttcacgtgactcgtacacatgacttccagtccccgggcgcctcctggagagcaaggacgcgggggagcagagatgatccgagccgcgccgccgccgctgttcctgctgctgctgctgctgctgctgctagtgtcctgggcgtcccgaggcgaggcagcccccgaccaggacgagatccagcgcctccccgggctggccaagcagccgtctttccgccagtactccggctacctcaaaggctccggctccaagcacctccactactggtttgtggagtcccagaaggatcccgagaacagccctgtggtgctttggctcaatgggggtcccggctgcagctcactagatgggctcctcacagagcatggccccttcctggtccagccagatggtgtcaccctggagtacaacccctattcttggaatctgattgccaatgtgttatacctggagtccccagctggggtgggcttctcctactccgatgacaagttttatgcaactaatgacactgaggtcgcccagagcaattttgaggcccttcaagatttcttccgcctctttccggagtacaagaacaacaaacttttcctgaccggggagagctatgctggcatctacatccccaccctggccgtgctggtcatgcaggatcccagcatgaaccttcaggggctggctgtgggcaatggactctcctcctatgagcagaatgacaactccctggtctactttgcctactaccatggccttctggggaacaggctttggtcttctctccagacccactgctgctctcaaaacaagtgtaacttctatgacaacaaagacctggaatgcgtgaccaatcttcaggaagtggcccgcatcgtgggcaactctggcctcaacatctacaatctctatgccccgtgtgctggaggggtgcccagccattttaggtatgagaaggacactgttgtggtccaggatttgggcaacatcttcactcgcctgccactcaagcggatgtggcatcaggcactgctgcgctcaggggataaagtgcgcatggaccccccctgcaccaacacaacagctgcttccacctacctcaacaacccgtacgtgcggaaggccctcaacatcccggagcagctgccacaatgggacatgtgcaactttctggtaaacttacagtaccgccgtctctaccgaagcatgaactcccagtatctgaagctgcttagctcacagaaataccagatcctattatataatggagatgtagacatggcctgcaatttcatgggggatgagtggtttgtggattccctcaaccagaagatggaggtgcagcgccggccctggttagtgaagtacggggacagcggggagcagattgccggcttcgtgaaggagttctcccacatcgcctttctcacgatcaagggcgccggccacatggttcccaccgacaagcccctcgctgccttcaccatgttctcccgcttcctgaacaagcagccatactgatgaccacagcaaccagctccacggcctgatgcagcccctcccagcctctcccgctaggagagtcctcttctaagcaaagtgcccctgcaggccgggttctgccgccaggactgcccccttcccagagccctgtacatcccagactgggcccagggtctcccatagacagcctgggggcaagttagcactttattcccgcagcagttcctgaatggggtggcctggccccttctctgcttaaagaatgccctttatgatgcactgattccatcccaggaacccaacagagctcaggacagcccacagggaggtggtggacggactgtaattgatagattgattatggaattaaattgggtacagcttcaaaaaaaaaaaaaaaa

SEQ ID NO: 350 - protein, 498 aa, Homo sapiens
MTSSPRAPPGEQGRGGAEMIRAAPPPLFLLLLLLLLLVSWASRGEAAPDQDEIQRLPGLAKQPSFRQYSGYLKGSGSKHLHYWFVESQKDPENSPVVLWLNGGPGCSSLDGLLTEHGPFLVQPDGVTLEYNPYSWNLIANVLYLESPAGVGFSYSDDKFYATNDTEVAQSNFEALQDFFRLFPEYKNNKLFLTGESYAGIYIPTLAVLVMQDPSMNLQGLAVGNGLSSYEQNDNSLVYFAYYHGLLGNRLWSSLQTHCCSQNKCNFYDNKDLECVTNLQEVARIVGNSGLNIYNLYAPCAGGVPSHFRYEKDTVVVQDLGNIFTRLPLKRMWHQALLRSGDKVRMDPPCTNTTAASTYLNNPYVRKALNIPEQLPQWDMCNFLVNLQYRRLYRSMNSQYLKLLSSQKYQILLYNGDVDMACNFMGDEWFVDSLNQKMEVQRRPWLVKYGDSGEQIAGFVKEFSHIAFLTIKGAGHMVPTDKPLAAFTMFSRFLNKQPY

SEQ ID NO: 351 - DNA, 1847 bp, Homo sapiens
cagaaggccgtggggagtgggggccagtgcctgcagcctgccctgcctctctcacaggcccttagagcatcgccaggtgcagagctccacagctctctttcccaaggagtaatcagagggtgagaacgtggagcctggtggacaggtgaaagcactgggatctttctgcccagaaaggggaaagttgcacatttatatcctagagggaagcgacagcagtgcttctccctgtgctgaggtacaggagccatgtggctagaaatcctcctcacttcagtgctgggctttgccatctactggttcatctcccgggacaaagaggaaactttgccacttgaagatgggtggtgggggccaggcacgaggtccgcagccagggaggacgacagcatccgccctttcaaggtggaaacgtcagatgaggagatccacgacttacaccagaggatcgataagttccgtttcaccccacctttggaggacagctgcttccactatggcttcaactccaactacctgaagaaagtcatctcctactggcggaatgaatttgactggaagaagcaggtggagattctcaacagataccctcacttcaagactaagattgaagggctggacatccacttcatccacgtgaagcccccccagctgcccgcaggccataccccgaagcccttgctgatggtgcacggctggcccggctctttctacgagttttataagatcatcccactcctgactgaccccaagaaccatggcctgagcgatgagcacgtttttgaagtcatctgcccttccatccctggctatggcttctcagaggcatcctccaagaaggggttcaactcggtggccaccgccaggatcttttacaagctgatgctgcggctgggcttccaggaattctacattcaaggaggggactgggggtccctgatctgcactaatatggcccagctggtgcccagccacgtgaaaggcctgcacttgaacatggctttggttttaagcaacttctctaccctgaccctcctcctgggacagcgtttcgggaggtttcttggcctcactgagagggatgtggagctgctgtaccccgtcaaggagaaggtattctacagcctgatgagggagagcggctacatgcacatccagtgcaccaagcctgacaccgtaggctctgctctgaatgactctcctgtgggtctggctgcctatattctagagaagttttccacctggaccaatacggaattccgatacctggaggatggaggcctggaaaggaagttctccctggacgacctgctgaccaacgtcatgctctactggacaacaggcaccatcatctcctcccagcgcttctacaaggagaacctgggacagggctggatgacccagaagcatgagcggatgaaggtctatgtgcccactggcttctctgccttcccttttgagctattgcacacgcctgaaaagtgggtgaggttcaagtacccaaagctcatctcctattcctacatggttcgtgggggccactttgcggcctttgaggagccggagctgctcgcccaggacatccgcaagttcctgtcggtgctggagcggcaatgacccacccctctccccccgcctgccacctccccccacaagtgccctccaggcttttcttggggaagataccccttttctgaggaatgagtttgcctccgtcccctgcccatgctgggagcccacgctcaccccctcacccctccaagctcactccccaacccccaactccgtgtggtaagcaacatggctttgatgataaacgactttactctaaaaaaaaaaaaaaaaaa

SEQ ID NO: 352 - protein, 455 aa, Homo sapiens
MWLEILLTSVLGFAIYWFISRDKEETLPLEDGWWGPGTRSAAREDDSIRPFKVETSDEEIHDLHQRIDKFRFTPPLEDSCFHYGFNSNYLKKVISYWRNEFDWKKQVEILNRYPHFKTKIEGLDIHFIHVKPPQLPAGHTPKPLLMVHGWPGSFYEFYKIIPLLTDPKNHGLSDEHVFEVICPSIPGYGFSEASSKKGFNSVATARIFYKLMLRLGFQEFYIQGGDWGSLICTNMAQLVPSHVKGLHLNMALVLSNFSTLTLLLGQRFGRFLGLTERDVELLYPVKEKVFYSLMRESGYMHIQCTKPDTVGSALNDSPVGLAAYILEKFSTWTNTEFRYLEDGGLERKFSLDDLLTNVMLYWTTGTIISSQRFYKENLGQGWMTQKHERMKVYVPTGFSAFPFELLHTPEKWVRFKYPKLISYSYMVRGGHFAAFEEPELLAQDIRKFLSVLERQ

SEQ ID NO: 353 - DNA, 1857 bp, Homo sapiens
agttcacccaatggacctgcctactgcagcgtaggcctcgcctcaacggcaggagagcaggcggctgcggttgctgcagccttcagtctccacccggactacgccatgttggggtttgtgggtcgggtggccgctgctccggcctccggggccttgcggagactcaccccttcagcgtcgctgcccccagctcagctcttactgcgggccgctccgacggcggtccatcctgtcagggactatgcggcgcaaacatctccttcgccaaaagcaggcgccgccaccgggcgcatcgtggcggtcattggcgcagtggtggacgtccagtttgatgagggactaccaccaattctaaatgccctggaagtgcaaggcagggagaccagactggttttggaggtggcccagcatttgggtgagagcacagtaaggactattgctatggatggtacagaaggcttggttagaggccagaaagtactggattctggtgcaccaatcaaaattcctgttggtcctgagactttgggcagaatcatgaatgtcattggagaacctattgatgaaagaggtcccatcaaaaccaaacaatttgctcccattcatgctgaggctccagagttcatggaaatgagtgttgagcaggaaattctggtgactggtatcaaggttgtcgatctgctagctccctatgccaagggtggcaaaattgggctttttggtggtgctggagttggcaagactgtactgatcatggagttaatcaacaatgtcgccaaagcccatggtggttactctgtgtttgctggtgttggtgagaggacccgtgaaggcaatgatttataccatgaaatgattgaatctggtgttatcaacttaaaagatgccacctctaaggtagcgctggtatatggtcaaatgaatgaaccacctggtgctcgtgcccgggtagctctgactgggctgactgtggctgaatacttcagagaccaagaaggtcaagatgtactgctatttattgataacatctttcgcttcacccaggctggttcagaggtgtctgcattattgggccgaatcccttctgctgtgggctatcagcctaccctggccactgacatgggtactatgcaggaaagaattaccactaccaagaagggatctatcacctctgtacaggctatctatgtgcctgctgatgacttgactgaccctgcccctgctactacgtttgcccatttggatgctaccactgtactgtcgcgtgccattgctgagctgggcatctatccagctgtggatcctctagactccacctctcgtatcatggatcccaacattgttggcagtgagcattacgatgttgcccgtggggtgcaaaagatcctgcaggactacaaatccctccaggatatcattgccatcctgggtatggatgaactttctgaggaagacaagttgaccgtgtcccgtgcacggaaaatacagcgtttcttgtctcagccattccaggttgctgaggtcttcacaggtcatatggggaagctggtacccctgaaggagaccatcaaaggattccagcagattttggcaggtgaatatgaccatctcccagaacaggccttctatatggtgggacccattgaagaagctgtggcaaaagctgataagctggctgaagagcattcatcgtgaggggtctttgtcctctgtactgtctctctccttgcccctaacccaaaaagcttcatttttctgtgtaggctgcacaagagccttgattgaagatatattctttctgaacagtatttaaggtttccaataaaatgtacacccctcagaaaaaaaaaaaaaaaa

SEQ ID NO: 354 - protein, 529 aa, Homo sapiens
MLGFVGRVAAAPASGALRRLTPSASLPPAQLLLRAAPTAVHPVRDYAAQTSPSPKAGAATGRIVAVIGAVVDVQFDEGLPPILNALEVQGRETRLVLEVAQHLGESTVRTIAMDGTEGLVRGQKVLDSGAPIKIPVGPETLGRIMNVIGEPIDERGPIKTKQFAPIHAEAPEFMEMSVEQEILVTGIKVVDLLAPYAKGGKIGLFGGAGVGKTVLIMELINNVAKAHGGYSVFAGVGERTREGNDLYHEMIESGVINLKDATSKVALVYGQMNEPPGARARVALTGLTVAEYFRDQEGQDVLLFIDNIFRFTQAGSEVSALLGRIPSAVGYQPTLATDMGTMQERITTTKKGSITSVQAIYVPADDLTDPAPATTFAHLDATTVLSRAIAELGIYPAVDPLDSTSRIMDPNIVGSEHYDVARGVQKILQDYKSLQDIIAILGMDELSEEDKLTVSRARKIQRFLSQPFQVAEVFTGHMGKLVPLKETIKGFQQILAGEYDHLPEQAFYMVGPIEEAVAKADKLAEEHSS

SEQ ID NO: 355 - DNA, 1005 bp, Homo sapiens
cagacgtccctgcgcgtcgtcctcctcgccctccaggccgcccgcgccgcgccggagtccgctgtccgccagctacccgcttcctgccgcccgccgctgccatgctgcccgccgcgctgctccgccgcccgggacttggccgcctcgtccgccacgcccgtgcctatgccgaggccgccgccgccccggctgccgcctctggccccaaccagatgtccttcaccttcgcctctcccacgcaggtgttcttcaacggtgccaacgtccggcaggtggacgtgcccacgctgaccggagccttcggcatcctggcggcccacgtgcccacgctgcaggtcctgcggccggggctggtcgtggtgcatgcagaggacggcaccacctccaaatactttgtgagcagcggttccatcgcagtgaacgccgactcttcggtgcagttgttggccgaagaggccgtgacgctggacatgttggacctgggggcagccaaggcaaacttggagaaggcccaggcggagctggtggggacagctgacgaggccacgcgggcagagatccagatccgaatcgaggccaacgaggccctggtgaaggccctggagtaggcggtgcgtacccggtgtcccgaggcccggccaggggctgggcagggatgccaggtgggcccagccagctcctggggtcccggccacctggggaagccgcgcctgccaaggaggccaccagagggcagtgcaggcttctgcctgggccccaggccctgcctgtgttgaaagctctggggactgggccagggaagctcctcctcagctttgagctgtggctgccacccatggggctctccttccgcctctcaagatccccccagcctgacgggccgcttaccatcccctctgccctgcagagccagccgccaaggttgacctcagcttcggagccacctctggatgaactgcccccagcccccgccccattaaagacccggaagcctgaaaaaaaaaa

SEQ ID NO: 356 - protein, 168 aa, Homo sapiens
MLPAALLRRPGLGRLVRHARAYAEAAAAPAAASGPNQMSFTFASPTQVFFNGANVRQVDVPTLTGAFGILAAHVPTLQVLRPGLVVVHAEDGTTSKYFVSSGSIAVNADSSVQLLAEEAVTLDMLDLGAAKANLEKAQAELVGTADEATRAEIQIRIEANEALVKALE

SEQ ID NO: 357 - DNA, 3125 bp, Homo sapiens
agggacttacccaaggtcacgcagcgagcccggtccccctgcgttccccggggagcgctgagccgggacgcggcggtggggtggggaaggggagtggcgcggccctgcggggtgaggctgccgtttgctgagtgtccggcaggggtctgctcgctgccagcccggcccctcctcagagcagctgccgcagcccgaggatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacggaactgctgtcaaacccccagttcattgtggatggagctacccgcacagacatctgccagggagcactgggggactgctggctcttggcggccatcgcctccctcactctcaacgacaccctcctgcaccgagtggttccgcacggccagagcttccagaatggctatgccggcatcttccatttccagctgtggcaatttggggagtgggtggacgtggtcgtggatgacctgctgcccatcaaggacgggaagctagtgttcgtgcactctgccgaaggcaacgagttctggagcgccctgcttgagaaggcctatgccaaggtaaatggcagctacgaggccctgtcagggggcagcacctcagagggctttgaggacttcacaggcggggttaccgagtggtacgagttgcgcaaggctcccagtgacctctaccagatcatcctcaaggcgctggagcggggctccctgctgggctgctccatagacatctccagcgttctagacatggaggccatcactttcaagaagttggtgaagggccatgcctactctgtgaccggggccaagcaggtgaactaccgaggccaggtggtgagcctgatccggatgcggaacccctggggcgaggtggagtggacgggagcctggagcgacagctcctcagagtggaacaacgtggacccatatgaacgggaccagctccgggtcaagatggaggacggggagttctggatgtcattccgagacttcatgcgggagttcacccgcctggagatctgcaacctcacacccgacgccctcaagagccggaccatccgcaaatggaacaccacactctacgaaggcacctggcggcgggggagcaccgcggggggctgccgaaactacccagccaccttctgggtgaaccctcagttcaagatccggctggatgagacggatgacccggacgactacggggaccgcgagtcaggctgcagcttcgtgctcgcccttatgcagaagcaccgtcgccgcgagcgccgcttcggccgcgacatggagactattggcttcgcggtctacgaggtccctccggagctggtgggccagccggccgtacacttgaagcgtgacttcttcctggccaatgcgtctcgggcgcgctcagagcagttcatcaacctgcgagaggtcagcacccgcttccgcctgccacccggggagtatgtggtggtgccctccaccttcgagcccaacaaggagggcgacttcgtgctgcgcttcttctcagagaagagtgctgggactgtggagctggatgaccagatccaggccaatctccccgatgagcaagtgctctcagaagaggagattgacgagaacttcaaggccctcttcaggcagctggcaggggaggacatggagatcagcgtgaaggagttgcggacaatcctcaataggatcatcagcaaacacaaagacctgcggaccaagggcttcagcctagagtcgtgccgcagcatggtgaacctcatggatcgtgatggcaatgggaagctgggcctggtggagttcaacatcctgtggaaccgcatccggaattacctgtccatcttccggaagtttgacctggacaagtcgggcagcatgagtgcctacgagatgcggatggccattgagtcggcaggcttcaagctcaacaagaagctgtacgagctcatcatcacccgctactcggagcccgacctggcggtcgactttgacaatttcgtttgctgcctggtgcggctagagaccatgttccgatttttcaaaactctggacacagatctggatggagttgtgacctttgacttgtttaagtggttgcagctgaccatgtttgcatgaggcagggactcggtcccccttgccgtgctcccctccctcctcgtctgccaagcctcgcctcctaccacaccacaccaggccaccccagctgcaagtgccttccttggagcagagaggcagcctcgtcctcctgtcccctctcctcccagccaccatcgttcatctgctccgggcagaactgtgtggcccctgcctgtgccagccatgggctcgggatggactccctgggccccacccattgccaagccaggaaggcagctttcgcttgttcctgcctcgggacagccccgggtttccccagcatcctgatgtgtcccctctccccacttcagaggccacccactcagcaccaccggcctggccttgcctgcagactataaactataaccactagctcgacacagtctgcagtccaggcgtgtggagccgcctcccggctcggggaggccccggggctgggaacgcctgtgccttcctgcgccgaagccaacgccccctctgtccttccctggccctgctgccgaccaggagctgcccagcctgtgggcggtcggccttccctccttcgctccttttttatattagtgattttaaaggggactcttcagggacttgtgtactggttatgggggtgccagaggcactaggcttggggtggggaggtcccgtgttccatatagaggaaccccaaataataaaaggccccacatctgtctgtgaaaaaaaaaaaaaaaaaaaaaaaaaaaaaaaaaaaaaaaaaaaaaaaaaaaaaaaaaaaaaaaa

SEQ ID NO: 358 - protein, 714 aa, Homo sapiens
MSEEIITPVYCTGVSAQVQKQRARELGLGRHENAIKYLGQDYEQLRVRCLQSGTLFRDEAFPPVPQSLGYKDLGPNSSKTYGIKWKRPTELLSNPQFIVDGATRTDICQGALGDCWLLAAIASLTLNDTLLHRVVPHGQSFQNGYAGIFHFQLWQFGEWVDVVVDDLLPIKDGKLVFVHSAEGNEFWSALLEKAYAKVNGSYEALSGGSTSEGFEDFTGGVTEWYELRKAPSDLYQIILKALERGSLLGCSIDISSVLDMEAITFKKLVKGHAYSVTGAKQVNYRGQVVSLIRMRNPWGEVEWTGAWSDSSSEWNNVDPYERDQLRVKMEDGEFWMSFRDFMREFTRLEICNLTPDALKSRTIRKWNTTLYEGTWRRGSTAGGCRNYPATFWVNPQFKIRLDETDDPDDYGDRESGCSFVLALMQKHRRRERRFGRDMETIGFAVYEVPPELVGQPAVHLKRDFFLANASRARSEQFINLREVSTRFRLPPGEYVVVPSTFEPNKEGDFVLRFFSEKSAGTVELDDQIQANLPDEQVLSEEEIDENFKALFRQLAGEDMEISVKELRTILNRIISKHKDLRTKGFSLESCRSMVNLMDRDGNGKLGLVEFNILWNRIRNYLSIFRKFDLDKSGSMSAYEMRMAIESAGFKLNKKLYELIITRYSEPDLAVDFDNFVCCLVRLETMFRFFKTLDTDLDGVVTFDLFKWLQLTMFA

SEQ ID NO: 359 - DNA, 2373 bp, Homo sapiens
cccctcccttagcgggggcgcgcggcgctgaggaccgcacggaaacggggaagtcaggtggccgctgccgccgccgccgccgcggtttgtcgccagaaggaagatggcggatctggaggagcagttgtctgatgaagagaaggtgcgtatagcagcaaaattcatcattcatgcccctcctggagaatttaatgaggttttcaatgatgttcggttactgcttaataatgacaatcttctcagggaaggagcagcccatgcatttgcacagtataacttggaccagtttactccagtaaaaattgaaggttatgaagatcaggtattgataacagaacatggcgacttgggaaatggaaagtttttggatccaaagaacagaatctgttttaaatttgatcacttaaggaaggaggcaactgatccaagaccctgtgaagtagaaaatgcagttgaatcatggagaacttcagtagaaactgctctgagagcttacgtaaaagaacattacccgaatggagtctgcactgtgtatggcaaaaaaatagatggacagcaaaccattattgcatgcatagaaagccatcagttccaagcaaaaaatttttggaatggtcgttggaggtcagaatggaagtttacaatcactccttcaaccactcaagtggttggcatcttgaaaattcaggttcattattatgaagatggtaatgttcagctagtgagtcataaagatatacaagattccctaacagtgtctaatgaagtgcaaacagcaaaagaatttataaagattgtagaagctgcagaaaatgaataccagactgccatcagtgagaattatcagacaatgtcggacactactttcaaagccttacgtcgacagttgccagttacacgcactaagattgattggaacaagatccttagctacaagattggcaaagagatgcagaatgcataagatgaacattgcatgaccggatcattttagtgtctttgcgttaaaaaatcattgcaaaagtattctgaactgtcaagctgcccagtcagatgggctgttgccatttaaaatcactgtaattaattagtttgattagagcacaaagcttagctaatcaaccattatttttcattttgtttgttctaagaggattgaaaatcagtttagtttaaatgtctttctgttaggcctttctttcttacaatgaagagatgattcttctagtttatggttaaaagtttttgaagtgtctcaaaaatattttactaactgtaaccctaaaattgatgtcttttggtttatgaaatcagtaatttttgatatttccccagttctttttaatggggtcaataatggacattctagtttaaggtggttgatggatttagccatatatgctgctaaagaaattgtctaccttttcttcctcacctgttccatttatgtaaagttgagattagagggaaagcattttctatatcaattgtgtttaaacctttcaagaaggttatttagctagcttagtgttgaactaaattttttttaaacaaggcaaggtctaatgctgttttgagattctgaaattaatgaaaatacttatttcagaaatgcatttaatgctttttttcttgtgacagttacgcaaatcagcttgaattccatatgtccctgagttatttttatcataaagccacaaatgtattataacaaggcaaattgtaatatatataatcctgaactcatgaccatgtctcggtttattttttttttcttggattgaaaagtactgaaattcaatgtgacattaaaatgcaaattttcctatttatttgagtagaaaatcacttaccagtgagcatatatattttaaaatactttctttggatattgtaattcttaactggttgtaaattagaaaagctgggattacatatggtgtgcggttacagtctaaattttttcatcctcctatgcatcataagcatgtttgtaatattttcaaaaatagttctactgatgctacaggaatttcaagcctgtggtgaatgttagtatttaccatagggagtgaagtggagttatggtttcattcaatagagtattgctgattatacttgagtggaatcctttcctcacgtactcccacagacgtctgggcctggaaattttttttttattttattttattgtttttttttttagaaaaacaccacttttattatgtacaataaaatatttcattagcttgaattgtatagatttttaaaaattcaatgaaagcatgttgtttaatttctttttaaaatcactgttgggctttgaaagcattgagaatataatatgaaattatgaaaaaaaaaaaaaaaaaa

SEQ ID NO: 360 - protein, 286 aa, Homo sapiens
MADLEEQLSDEEKVRIAAKFIIHAPPGEFNEVFNDVRLLLNNDNLLREGAAHAFAQYNLDQFTPVKIEGYEDQVLITEHGDLGNGKFLDPKNRICFKFDHLRKEATDPRPCEVENAVESWRTSVETALRAYVKEHYPNGVCTVYGKKIDGQQTIIACIESHQFQAKNFWNGRWRSEWKFTITPSTTQVVGILKIQVHYYEDGNVQLVSHKDIQDSLTVSNEVQTAKEFIKIVEAAENEYQTAISENYQTMSDTTFKALRRQLPVTRTKIDWNKILSYKIGKEMQNA

SEQ ID NO: 361 - DNA, 1948 bp, Homo sapiens
atagagtagcggaagtggtccgttctcttcctctcccggcccaagcttctgggtatttctattgcgcgaggcattgtgggttgctgggcggcccggtctcggagaagaggggagagtggcgggccgctgaataagcttccaaaatgatgcccacaccagttatcctattgaaagaggggactgatagctcccaaggcatcccccagcttgtgagtaacatcagtgcctgccaggtgattgctgaggctgtaagaactaccctgggtccccgtggcatggacaagcttattgtagatggcagaggcaaagcaacaatttctaatgatggggccacaattctgaaacttcttgatgttgtccatcctgcagcaaagactttggtagacattgccaaatcccaagatgctgaggtgggtgatggcaccacctcagtgaccttgctggctgcagagtttctgaagcaggtgaaaccctatgtggaggaaggtttacacccccagatcatcattcgagctttccgcacagccacccagctggcagttaacaagatcaaagagattgctgtgaccgtgaagaaggcagataaagtggagcagaggaagctgctggaaaagtgtgccatgaccgctctgagctccaagctgatctcccagcagaaagctttctttgctaagatggtggtggatgcagtgatgatgctcgatgatttgctgcagcttaaaatgattggaatcaagaaggtacagggtggagccctcgaggattctcagctggtagctggtgttgcattcaagaagactttctcttacgctgggtttgaaatgcaacccaaaaagtaccacaatcccaagattgcccttttgaatgtcgagctcgagttgaaagctgagaaagacaatgctgagataagagtccacacagttgaggattatcaggcaattgttgatgctgagtggaacattctctatgacaagttagagaagatccatcattctggagccaaagttgtcttgtccaaactccccattggggatgtggccacccagtactttgctgacagggacatgttctgtgctggccgagtacctgaggaggatctgaagaggacaatgatggcctgtggaggctcaatccagaccagtgtgaatgctctgtcagcagatgtgctgggtcgatgccaggtgtttgaagagacccagattggaggcgagaggtacaatttttttactggctgccccaaggccaagacatgcaccttcattctccgtggcggcgccgagcagtttatggaggagacagagcggtccctgcatgatgccatcatgatcgtcaggagggccatcaagaatgattcagtggtggctggtggcggggccattgagatggaactctccaagtacctgcgggattactcaaggactattccaggaaaacagcagctgttgattggggcatatgccaaggccttggagattatcccacgccagctgtgtgacaatgctggctttgatgccacaaacattctcaacaagctgcgggctcggcatgcccaggggggtacatggtatggagtagacatcaacaacgaggacattgctgacaactttgaagctttcgtgtgggagccagctatggtgcggatcaatgcgctgacagcagcctctgaggctgcgtgcctgatcgtgtctgtagatgaaaccatcaagaacccccgctcgactgtggatgctcccacagcagcaggccggggccgtggtcgtggccgcccccactgagaggcaccccacccatcacatggctggctggctgctgggtgcacttaccctccttggcttggttacttcattttacaaggaaggggtagtaattggcccactctcttcttactggaggctatttaaataaaatgtaagacttcagataactttgtaaattaaaaaaaaaaaaa

SEQ ID NO: 362 - protein, 543 aa, Homo sapiens
MMPTPVILLKEGTDSSQGIPQLVSNISACQVIAEAVRTTLGPRGMDKLIVDGRGKATISNDGATILKLLDVVHPAAKTLVDIAKSQDAEVGDGTTSVTLLAAEFLKQVKPYVEEGLHPQIIIRAFRTATQLAVNKIKEIAVTVKKADKVEQRKLLEKCAMTALSSKLISQQKAFFAKMVVDAVMMLDDLLQLKMIGIKKVQGGALEDSQLVAGVAFKKTFSYAGFEMQPKKYHNPKIALLNVELELKAEKDNAEIRVHTVEDYQAIVDAEWNILYDKLEKIHHSGAKVVLSKLPIGDVATQYFADRDMFCAGRVPEEDLKRTMMACGGSIQTSVNALSADVLGRCQVFEETQIGGERYNFFTGCPKAKTCTFILRGGAEQFMEETERSLHDAIMIVRRAIKNDSVVAGGGAIEMELSKYLRDYSRTIPGKQQLLIGAYAKALEIIPRQLCDNAGFDATNILNKLRARHAQGGTWYGVDINNEDIADNFEAFVWEPAMVRINALTAASEAACLIVSVDETIKNPRSTVDAPTAAGRGRGRGRPH

SEQ ID NO: 363 - DNA, 3783 bp, Homo sapiens
ggggcggggccgggagggtacttagggccggggctggcccaggctacggcggctgcagggctccggcaaccgctccggcaacgccaaccgctccgctgcgcgcaggctgggctgcaggctctcggctgcagcgctgggtggatctaggatccggcttccaacatgtggcagctctgggcctccctctgctgcctgctggtgttggccaatgcccggagcaggccctctttccatcccctgtcggatgagctggtcaactatgtcaacaaacggaataccacgtggcaggccgggcacaacttctacaacgtggacatgagctacttgaagaggctatgtggtaccttcctgggtgggcccaagccaccccagagagttatgtttaccgaggacctgaagctgcctgcaagcttcgatgcacgggaacaatggccacagtgtcccaccatcaaagagatcagagaccagggctcctgtggctcctgctgggccttcggggctgtggaagccatctctgaccggatctgcatccacaccaatgcgcacgtcagcgtggaggtgtcggcggaggacctgctcacatgctgtggcagcatgtgtggggacggctgtaatggtggctatcctgctgaagcttggaacttctggacaagaaaaggcctggtttctggtggcctctatgaatcccatgtagggtgcagaccgtactccatccctccctgtgagcaccacgtcaacggctcccggcccccatgcacgggggagggagatacccccaagtgtagcaagatctgtgagcctggctacagcccgacctacaaacaggacaagcactacggatacaattcctacagcgtctccaatagcgagaaggacatcatggccgagatctacaaaaacggccccgtggagggagctttctctgtgtattcggacttcctgctctacaagtcaggagtgtaccaacacgtcaccggagagatgatgggtggccatgccatccgcatcctgggctggggagtggagaatggcacaccctactggctggttgccaactcctggaacactgactggggtgacaatggcttctttaaaatactcagaggacaggatcactgtggaatcgaatcagaagtggtggctggaattccacgcaccgatcagtactgggaaaagatctaatctgccgtgggcctgtcgtgccagtcctgggggcgagatcggggtagaaatgcattttattctttaagttcacgtaagatacaagtttcagacagggtctgaaggactggattggccaaacatcagacctgtcttccaaggagaccaagtcctggctacatcccagcctgtggttacagtgcagacaggccatgtgagccaccgctgccagcacagagcgtccttccccctgtagactagtgccgtagggagtacctgctgccccagctgactgtggccccctccgtgatccatccatctccagggagcaagacagagacgcaggaatggaaagcggagttcctaacaggatgaaagttcccccatcagttcccccagtacctccaagcaagtagctttccacatttgtcacagaaatcagaggagagacggtgttgggagccctttggagaacgccagtctcccaggccccctgcatctatcgagtttgcaatgtcacaacctctctgatcttgtgctcagcatgattctttaatagaagttttattttttcgtgcactctgctaatcatgtgggtgagccagtggaacagcgggagacctgtgctagttttacagattgcctccttatgacgcggctcaaaaggaaaccaagtggtcaggagttgtttctgacccactgatctctactaccacaaggaaaatagtttaggagaaaccagcttttactgtttttgaaaaattacagcttcaccctgtcaagttaacaaggaatgcctgtgccaataaaagttttctccaacttgaagtctactctgatgggatctcagatcctttgtcactgcctatagacttgtagctgctgtctctctttgtccctgcagagaatcacgtcctggaactgcatgttcttgcgactcttgggacttcatcttaacttctcgctgccccagccatgttttcaaccatggcatccctcccccaattagttccctgtcatcctcgtcaaccttctctgtaagtgcctggtaagcttgcccttgcttaagaactcaaaacatagctgtgctctatttttttgttgttgttgtgactgacagagtgagattccgtctcccaggctggagtgcagtggcgccttctcagctcactgcaacctgcagcctcctagattcaagcgattctcctgcttcagccttccgagtagctgggatgacaggcactcaccaatatgcctgggtaatttttgtatttttaagtacatacaggatttcaccatgttggccaggctagtttcaaactcccggcctcaggtggtctgcctgcctcagcctcccaaagtgttgggattacaggcgtgagccactgggccctgcctgtattttttatcagccacaaatccagcaacaagctgaggattcagctcataaaacaggcttggtgtcttggtgatctcacataaccaagatgctaccccgtggggaaccacatccccctggatgccctccagccttggtttgggctggagtcagggcctgtatacagtattttgaatttgtatgccactggtttgcattgctggtcaggaactctagtgctttgcatagccctggtttagaaacatgttatagcagttcttggtatagagcaaactagaagaaccagcaatcattccactgtcctgccaaggtacacctcagtactccccttcccaactgaagtggtatgaggctagctctttccaaaagcattcaagtttggcttctgatgtgactcagaatttaggaaccagatgctagatcaaataagctctgaaaatctgaggaacattgtaggaaaggtttgttaagcatctcttaagtgccatgatgagcataacagccggccgtcgtggctcacgcctgtaatcccagcactttgggaggccaaggtgggaggatgacaaggtcaggagttcaagaccagcctggccaacatgctgaaacctcacctctactaaaaatacaaaaattagctgggcatggtggcacatgcctgtaatcccagctacttgggaggctgaggcaggagaatcgcttgaacccgggaggcggaggttgcagtgagccaagacagtgccagtgcactccagcctcggtgacagcgcaaggctccgtctcaataattaaaaaaaaaaaaaaaaaaaaaaaggccgggcgcagtggctcaagcctgtaatcccagcactttgggaggctgaggcgggcagatcacctgaggtcaggagttttgagatcagccttggcaacacggtgaaaccccatctctactaaaaatacaaaattagccaagcatgctggcacatgcctgtaatcccagctactcgggaggctgaggtacgagaatcgcttgaacctgggaggcagaggatgcagtgagccgagatcacgccattgcactccagcctgggggacaagagtgaatctgtgtctcaccaaaaaaaaaaagaaaaagaaagatgcttaacaaaggttaccataagccacaaattcataaccacttatccttccagtttcaagtagaatatattcataacctcaataaagttctccctgctcccaaa

SEQ ID NO: 364 - protein, 339 aa, Homo sapiens
MWQLWASLCCLLVLANARSRPSFHPLSDELVNYVNKRNTTWQAGHNFYNVDMSYLKRLCGTFLGGPKPPQRVMFTEDLKLPASFDAREQWPQCPTIKEIRDQGSCGSCWAFGAVEAISDRICIHTNAHVSVEVSAEDLLTCCGSMCGDGCNGGYPAEAWNFWTRKGLVSGGLYESHVGCRPYSIPPCEHHVNGSRPPCTGEGDTPKCSKICEPGYSPTYKQDKHYGYNSYSVSNSEKDIMAEIYKNGPVEGAFSVYSDFLLYKSGVYQHVTGEMMGGHAIRILGWGVENGTPYWLVANSWNTDWGDNGFFKILRGQDHCGIESEVVAGIPRTDQYWEKI

SEQ ID NO: 365 - DNA, 747 bp, Homo sapiens
gccggaagtgacgcagggcagcggcgtcgcgggggcggggctcgggaaagacccgtgccagcgggcgtgtggccgcgggtttcgcacggtccaataagggagggcggcgtggcccggcctggtagcgacgaggacgcgcctgcgcagaggcggcagcaccaccggggttgactccgggggcgcggcgaggagagacatgaggctgagctggttccgggtcctgacagtactgtccatctgcctgagcgccgtggccacggccacgggggccgagggcaaaaggaagctgcagatcggggtcaagaagcgggtggaccactgtcccatcaaatcgcgcaaaggggatgtcctgcacatgcactacacggggaagctggaagatgggacagagtttgacagcagcctgccccagaaccagccctttgtcttctcccttggcacaggccaggtcatcaagggctgggaccaggggctgctggggatgtgtgagggggaaaagcgcaagctggtgatcccatccgagctagggtatggagagcggggagctcccccaaagattccaggcggtgcaaccctggtgttcgaggtggagctgctcaaaatagagcgacgaactgagctgtaaccagactggggaggggcagggggagaggcccccatcagggaccagactgttccaaaaaaaaaacaaaaaacaaaaacaaacaaaaaaacacttaaaagcccaaggaaaaaaaaaaaaaaaaa

SEQ ID NO: 366 - protein, 142 aa, Homo sapiens
MRLSWFRVLTVLSICLSAVATATGAEGKRKLQIGVKKRVDHCPIKSRKGDVLHMHYTGKLEDGTEFDSSLPQNQPFVFSLGTGQVIKGWDQGLLGMCEGEKRKLVIPSELGYGERGAPPKIPGGATLVFEVELLKIERRTEL

SEQ ID NO: 367 - DNA, 9149 bp, Homo sapiens
ccctggagggagagagagccagagagcggccgagcgcctaggaggcccgccgagcctcgccgagccccgccagccccggcgcgagagaagttggagaggagagcagcgcagcgcagcgagtcccgtggtcgcgccccaacagcgcccgacagcccccgatagcccaaaccgcggccctagccccggccgcacccccagcccgcgccagcatgatgaacaacagcggctactcagacgccggcctcggcctgggcgatgagacagacgagatgccgtccacggagaaggacctggcggaggacgcgccgtggaagaagatccagcagaacacattcacgcgctggtgcaatgagcacctcaagtgcgtgggcaagcgcctgaccgacctgcagcgcgacctcagcgacgggctccggctcatcgcgctgctcgaggtgctcagccagaagcgcatgtaccgcaagttccatccgcgccccaacttccgccaaatgaagctggagaacgtgtccgtggccctcgagttcctcgagcgcgagcacatcaagctcgtgtccatagacagcaaggccatcgtggatgggaacctgaagctgatcctgggcctgatctggacgctgatcctgcactactccatctccatgcccatgtgggaggatgaagatgatgaggatgcccgcaaacagacgcccaagcagcggctgcttggctggatccagaacaaggtgccccagctgcccatcaccaacttcaaccgtgactggcaggacggcaaagctctgggcgccctggtggacaactgcgcccccggtctctgccccgactgggaggcctgggaccccaaccagcccgtggagaacgcccgggaggccatgcagcaggccgacgactggcttggggtgccccaggtcattgcccctgaggagattgtggaccccaacgtggatgagcattctgttatgacctacctgtcccagttccccaaggccaagctcaaacctggtgcccctgttcgatccaagcagctgaaccccaagaaagccatcgcctatgggcctggcatcgagccacagggcaacaccgtgctgcagcctgcccacttcaccgtgcagacggtggacgcgggcgtgggcgaggtgctggtctacatcgaggaccctgaaggccacaccgaggaggctaaggtggttcccaacaatgacaaggatcgcacctatgctgtctcctatgtgcccaaggtcgctgggttacacaaggtgaccgtgctctttgctggccagaacattgaacgcagtccctttgaggtgaacgtgggcatggccctgggagatgccaacaaggtgtcagcccgtggccctggcctggaacctgtgggcaatgtggccaacaaacccacctactttgacatctacactgcgggggccggcactggcgatgttgctgtggtgatcgtggacccacagggccggcgggacacagtggaggtggccctggaggacaagggtgacagcacgttccgctgcacatacagacctgccatggaggggccacataccgtgcatgtggcctttgcgggtgcccccatcacccgcagtcccttccctgtccatgtgtcggaagcctgtaaccccaacgcctgccgcgcctctgggcgaggcctgcagcccaagggtgttcgcgtgaaagaggtggctgacttcaaggtgtttaccaagggtgccggcagcggggagctcaaggtcacggtcaaggggccaaagggcacagaggagccagtgaaggtgcgggaggctggggatggtgtgttcgagtgcgagtactacccggtggtgcctgggaagtatgtggtgaccatcacgtggggcggctacgccatccctcgcagcccctttgaggtacaggtgagcccagaggcaggagtgcaaaaggtccgggcctggggtcctggtttggagactggccaggtgggcaagtcagccgattttgtggtggaagccattggcaccgaggtggggacactgggcttctccatcgaggggccctcacaagccaagatcgaatgtgacgacaagggggatggctcctgcgatgtgcggtactggcccacggagcctggggagtacgctgtgcacgtcatctgtgacgatgaggacatccgagactcacccttcattgcccacatcctgcccgccccacctgactgcttcccagataaggtgaaggcctttgggcctggcctggagcctaccggctgcatcgtggacaagcccgctgagttcaccattgatgctcgtgcagctggcaagggagacctgaagctctatgcccaggacgccgacggctgtcccatcgacatcaaggtgatccccaacggcgacggcaccttccgctgctcctacgtgcccaccaagcccattaagcacaccatcatcatctcctggggaggcgtaaacgtgcccaagagccccttccgggtgaacgtgggcgagggcagccaccccgagcgggtaaaggtgtacggccccggagtggagaagacaggcctcaaggccaatgagcccacctacttcacggtggactgcagcgaggcggggcaaggcgacgtgagcatcggcatcaagtgcgccccaggcgtggtgggccctgcagaggctgacattgacttcgacatcatcaagaatgacaacgacaccttcaccgtcaagtacacgccaccaggggcgggccgctacaccatcatggtgctgtttgccaaccaggagatccccgccagccccttccacatcaaggtggacccatcccacgatgccagcaaagtcaaggccgagggccctgggctgaatcgcacaggtgtggaagtcgggaagcccacccacttcacggtgctgaccaagggagccggcaaggccaagctggatgtgcagtttgcagggacagccaagggcgaggttgtgcgggactttgagatcatagacaaccatgactactcctacactgtcaagtacaccgctgtccagcagggcaacatggcagtgacagtgacttatggcggggaccctgtccccaagagcccctttgtggtgaatgtggcacccccgctggacctcagcaaaatcaaagttcagggccttaatagcaaggtggctgtgggacaggaacaagcattctctgtgaacacacgaggggctggcggtcagggccaactggatgtgcggatgacttcgccctctcgccggcccatcccctgcaagctggagccaggcggtggagcggaagcccaggctgtgcgctacatgcccccggaggaggggccctacaaggtggatatcacctacgatggtcacccggtgcctggcagcccgtttgctgtggagggtgtcctgccccctgatccctccaaggtctgtgcttatggcccgggtctcaagggtggactggtaggcacccccgcgccattctccatcgacaccaagggggctggcacaggtggcctggggctgaccgtagagggcccctgcgaggccaagatcgagtgccaggacaatggtgatggctcatgtgctgtcagctacctgcccacggagcctggcgagtacaccatcaacatcctgtttgctgaggcccacatccctggctcgcccttcaaagccaccattcggcctgtgtttgacccgagcaaggtgcgggccagtggaccgggcctggagcgcggcaaggtcggtgaggcagccaccttcactgtggactgctcagaggcaggcgaggcggagctgaccattgagatcctgtcggatgccggggtcaaggccgaggtgctgatccacaacaacgcggatggcacctaccacatcacctacagccctgccttccctggcacctacaccattaccatcaagtatggcgggcatcccgtgcccaaattccccacccgtgtccatgtgcagcctgcggtcgataccagtggcgtcaaggtctcagggcctggtgttgagccacacggtgtcctgcgggaggtgaccactgagttcactgtggatgcaagatccctaacagccacaggcggcaaccacgtgacggctcgtgtgctcaacccctcgggggccaagacagacacctatgtgacagacaatggggacggcacctaccgagtgcagtacaccgcctacgaggagggcgtgcatctggtggaggtcctgtatgatgaggtcgctgtgcccaagagccccttccgagtgggcgtgaccgagggctgtgatcccacccgcgtccgagccttcgggccaggcctggagggtggcttggtcaacaaggccaaccgattcactgtggagaccaggggagcgggcaccgggggccttggcctagccatcgagggtccctcggaagccaagatgtcctgcaaggacaacaaggatggtagctgcaccgtggagtacatccccttcactcctggagactatgacgtcaacatcaccttcggggggcggcccatcccagggagcccgttccgcgtgccagtgaaggatgtggtggaccctgggaaggtgaagtgctcagggccagggctgggggctggtgtcagggcccgggttcctcagaccttcacagtggactgcagtcaagctggccgggcgcccctgcaggtggctgtgctgggccccacaggtgtggccgagcctgtggaggtgcgggacaatggagatggcacccacactgtccactacaccccagccactgacgggccctacacggtagccgtcaagtatgctgaccaggaggtgccacgcagccccttcaagatcaaggtcctcccagctcatgatgccagcaaggtgcgggccagcggcccaggcctcaacgcctctggcatccctgccagcctgcctgtggagttcaccatcgacgcacgggacgcgggcgaggggttgctcactgtccagatcttggaccccgagggtaagcccaagaaggccaacatccgggacaatggggatggcacgtacactgtgtcctacctgccggacatgagtggccggtacaccatcaccatcaagtatggcggtgatgagatcccctactcgcccttccgcatccatgctctgcccactggggatgccagcaagtgcctcgtcacagtgtccattggaggccatggcctgggtgcctgcctgggccctcgaatccagattgggcaggagacggtgatcacggtggatgccaaggcagccggtgaggggaaggtgacatgcacggtgtccacgccggatggggcagagctcgatgtggatgtggttgagaaccatgacggtacctttgacatctactacacagcgcccgagccgggcaagtacgtcatcaccatccgcttcgggggtgagcacatccccaacagccccttccacgtgctggcgtgtgaccccctgccgcacgaggaggagccctctgaagtgccacagctgcgccagccctacgctcctccccggcccggcgcccgccccacacactgggccacagaggagccagtggtgcctgtggagccaatggagtccatgctgaggcccttcaacctggtcatccccttcgcggtgcagaaaggggagctcacaggagaggtgcggatgccctcggggaagacggcacggcccaacatcaccgacaacaaggacggcaccatcacggtgaggtatgcacccactgagaaaggcctgcaccagatggggatcaagtatgacggcaaccacatccctgggagccccttacagttctatgtggatgccatcaacagccgccatgtcagtgcctatgggccaggcctgagccatggcatggtcaacaagccagccaccttcactattgtcaccaaagatgctggagaagggggtctgtcactggccgtggagggcccatccaaggcagagatcacctgtaaggacaacaaggatggcacctgcaccgtgtcctatctgccgactgcgcctggagactacagcatcatcgtgcgcttcgatgacaagcacatcccggggagccccttcacagccaagatcacaggtgatgactccatgaggacctcacagctgaatgtgggcacctccacggacgtgtcactgaagatcaccgagagtgatctgagccagctgaccgccagcatccgtgccccctcgggcaacgaggagccctgcctgctgaagcgcctgcccaaccggcacattgggatctccttcacccccaaggaggtcggggagcacgtggtgagcgtgcgcaagagtggcaagcatgtcaccaacagccccttcaagatcctggtggggccatctgagatcggggacgccagcaaggtgcgggtctggggcaaggggctttccgagggacacacattccaggtggcagagttcatcgtggacactcgcaatgcaggttatgggggcttggggctgagtattgaaggcccaagcaaggtggacatcaactgtgaggacatggaggacgggacatgcaaagtcacctactgccccaccgagcccggcacctacatcatcaacatcaagtttgctgacaagcacgtgcctggaagccccttcactgtgaaggtgaccggcgagggccgcatgaaggagagcatcacccggcggagacaggcaccttccatcgccaccatcggcagcacctgtgacctcaacctcaagatcccaggaaactggttccagatggtgtctgcccaggagcgcctgacacgcaccttcacacgcagcagccacacctacacccgcacggagcgcacggagatcagcaagacgcggggcggggagacaaagcgcgaggtgcgggtggaggagtccacccaggtcggcggggaccccttccctgctgtgtttggggacttcctgggccgggagcgcctgggatccttcggcagcatcacccggcagcaggagggtgaggccagctctcaggacatgactgcacaggtgaccagcccatcgggcaaggtggaagccgcagagatcgtcgagggcgaggacagcgcctacagcgtgcgctttgtgccccaggaaatggggccccatacggtcgctgtcaagtaccgtggccagcacgtgcccggcagcccctttcagttcactgtggggccgctgggtgaaggtggtgcccacaaggtgcgggccggaggcacagggctggagcgaggtgtggccggcgtgccagccgagttcagcatctggacccgggaggctggcgctgggggcctgtccattgctgtggagggtcctagcaaagcggagattgcatttgaggatcgcaaagatggctcctgcggcgtctcctatgtcgtccaggaaccaggtgactatgaggtctccatcaagttcaatgatgagcacatcccagacagcccctttgtggtgcctgtggcctccctctcggatgacgctcgccgtctcactgtcaccagcctccaggagacggggctcaaggtgaaccagccagcgtcctttgccgtgcagctgaacggtgcccggggcgtgattgatgcccgggtgcacacaccctcgggggctgtggaggagtgctacgtctctgagctggacagtgacaagcacaccatccgcttcatcccccacgagaatggcgtccactccatcgatgtcaagttcaacggtgcccacatccctggaagtcccttcaagatccgcgttggggagcagagccaggctggggacccaggcttggtgtcagcctacggtcctgggctcgagggaggcactaccggtgtgtcatcagagttcatcgtgaacaccctgaatgccggctcgggggccttgtctgtcaccattgatggcccctccaaggtgcagctggactgtcgggagtgtcctgagggccatgtggtcacttatactcccatggcccctggcaactacctcattgccatcaagtacggtggcccccagcacatcgtgggcagccccttcaaggccaaggtcactggtccgaggctgtccggaggccacagccttcacgaaacatccacggttctggtggagactgtgaccaagtcctcctcaagccggggctccagctacagctccatccccaagttctcctcagatgccagcaaggtggtgactcggggccctgggctgtcccaggccttcgtgggccagaagaactccttcaccgtggactgcagcaaagcaggcaccaacatgatgatggtgggcgtgcacggccccaagaccccctgtgaggaggtgtacgtgaagcacatggggaaccgggtgtacaatgtcacctacactgtcaaggagaaaggggactacatcctcattgtcaagtggggtgacgaaagtgtccctggaagccccttcaaagtcaaggtcccttgaatcccaaaagtgcctccccagcctcagcccccacctccagccacacacacattacacacacacacacacacacacaaatgtgccacacccagacacgcacagaatcagacactacaaacacctgccttgggggtgaagtgaaggcccagcctccccaccccaccgcgccccaggggttggaggaccttgtctgtgtcaggacagtgtccctccctgggaatgtgacatgagggccgactggggccaggctcaggggcagaggctgggacacaaggggctggcgagggctgcgaggccagggaagccctgagtttctggcggggctgagcagtgggggagcattgtgttgtgggtgtctgtgtgtgaggtcaccctcaaactgcaccgccggccagataccctcctgaccccgaggacttggtctggtctctctggtggctacaaccccagagttttaaggacttggaaaggaaagcacaatcagagaagaaaacagcccccgaaccagcaggagtggcctggcacatggaccggcctgagcgatgtgcactccacccaagccaggctcccagggggcctgatttctctctcactgtctctttttttaaaatggttgcacggctctgccccatggggggccttttttacacactgcgaggcccagctttctaggggacttttgcacatgtcatgcagctcagctgggagctgcttaggtggaaaactccaaataaagtgcggctgtcgcagaaaaaaaaaaaa

SEQ ID NO: 368 - protein, 2725 aa, Homo sapiens
MMNNSGYSDAGLGLGDETDEMPSTEKDLAEDAPWKKIQQNTFTRWCNEHLKCVGKRLTDLQRDLSDGLRLIALLEVLSQKRMYRKFHPRPNFRQMKLENVSVALEFLEREHIKLVSIDSKAIVDGNLKLILGLIWTLILHYSISMPMWEDEDDEDARKQTPKQRLLGWIQNKVPQLPITNFNRDWQDGKALGALVDNCAPGLCPDWEAWDPNQPVENAREAMQQADDWLGVPQVIAPEEIVDPNVDEHSVMTYLSQFPKAKLKPGAPVRSKQLNPKKAIAYGPGIEPQGNTVLQPAHFTVQTVDAGVGEVLVYIEDPEGHTEEAKVVPNNDKDRTYAVSYVPKVAGLHKVTVLFAGQNIERSPFEVNVGMALGDANKVSARGPGLEPVGNVANKPTYFDIYTAGAGTGDVAVVIVDPQGRRDTVEVALEDKGDSTFRCTYRPAMEGPHTVHVAFAGAPITRSPFPVHVSEACNPNACRASGRGLQPKGVRVKEVADFKVFTKGAGSGELKVTVKGPKGTEEPVKVREAGDGVFECEYYPVVPGKYVVTITWGGYAIPRSPFEVQVSPEAGVQKVRAWGPGLETGQVGKSADFVVEAIGTEVGTLGFSIEGPSQAKIECDDKGDGSCDVRYWPTEPGEYAVHVICDDEDIRDSPFIAHILPAPPDCFPDKVKAFGPGLEPTGCIVDKPAEFTIDARAAGKGDLKLYAQDADGCPIDIKVIPNGDGTFRCSYVPTKPIKHTIIISWGGVNVPKSPFRVNVGEGSHPERVKVYGPGVEKTGLKANEPTYFTVDCSEAGQGDVSIGIKCAPGVVGPAEADIDFDIIKNDNDTFTVKYTPPGAGRYTIMVLFANQEIPASPFHIKVDPSHDASKVKAEGPGLNRTGVEVGKPTHFTVLTKGAGKAKLDVQFAGTAKGEVVRDFEIIDNHDYSYTVKYTAVQQGNMAVTVTYGGDPVPKSPFVVNVAPPLDLSKIKVQGLNSKVAVGQEQAFSVNTRGAGGQGQLDVRMTSPSRRPIPCKLEPGGGAEAQAVRYMPPEEGPYKVDITYDGHPVPGSPFAVEGVLPPDPSKVCAYGPGLKGGLVGTPAPFSIDTKGAGTGGLGLTVEGPCEAKIECQDNGDGSCAVSYLPTEPGEYTINILFAEAHIPGSPFKATIRPVFDPSKVRASGPGLERGKVGEAATFTVDCSEAGEAELTIEILSDAGVKAEVLIHNNADGTYHITYSPAFPGTYTITIKYGGHPVPKFPTRVHVQPAVDTSGVKVSGPGVEPHGVLREVTTEFTVDARSLTATGGNHVTARVLNPSGAKTDTYVTDNGDGTYRVQYTAYEEGVHLVEVLYDEVAVPKSPFRVGVTEGCDPTRVRAFGPGLEGGLVNKANRFTVETRGAGTGGLGLAIEGPSEAKMSCKDNKDGSCTVEYIPFTPGDYDVNITFGGRPIPGSPFRVPVKDVVDPGKVKCSGPGLGAGVRARVPQTFTVDCSQAGRAPLQVAVLGPTGVAEPVEVRDNGDGTHTVHYTPATDGPYTVAVKYADQEVPRSPFKIKVLPAHDASKVRASGPGLNASGIPASLPVEFTIDARDAGEGLLTVQILDPEGKPKKANIRDNGDGTYTVSYLPDMSGRYTITIKYGGDEIPYSPFRIHALPTGDASKCLVTVSIGGHGLGACLGPRIQIGQETVITVDAKAAGEGKVTCTVSTPDGAELDVDVVENHDGTFDIYYTAPEPGKYVITIRFGGEHIPNSPFHVLACDPLPHEEEPSEVPQLRQPYAPPRPGARPTHWATEEPVVPVEPMESMLRPFNLVIPFAVQKGELTGEVRMPSGKTARPNITDNKDGTITVRYAPTEKGLHQMGIKYDGNHIPGSPLQFYVDAINSRHVSAYGPGLSHGMVNKPATFTIVTKDAGEGGLSLAVEGPSKAEITCKDNKDGTCTVSYLPTAPGDYSIIVRFDDKHIPGSPFTAKITGDDSMRTSQLNVGTSTDVSLKITESDLSQLTASIRAPSGNEEPCLLKRLPNRHIGISFTPKEVGEHVVSVRKSGKHVTNSPFKILVGPSEIGDASKVRVWGKGLSEGHTFQVAEFIVDTRNAGYGGLGLSIEGPSKVDINCEDMEDGTCKVTYCPTEPGTYIINIKFADKHVPGSPFTVKVTGEGRMKESITRRRQAPSIATIGSTCDLNLKIPGNWFQMVSAQERLTRTFTRSSHTYTRTERTEISKTRGGETKREVRVEESTQVGGDPFPAVFGDFLGRERLGSFGSITRQQEGEASSQDMTAQVTSPSGKVEAAEIVEGEDSAYSVRFVPQEMGPHTVAVKYRGQHVPGSPFQFTVGPLGEGGAHKVRAGGTGLERGVAGVPAEFSIWTREAGAGGLSIAVEGPSKAEIAFEDRKDGSCGVSYVVQEPGDYEVSIKFNDEHIPDSPFVVPVASLSDDARRLTVTSLQETGLKVNQPASFAVQLNGARGVIDARVHTPSGAVEECYVSELDSDKHTIRFIPHENGVHSIDVKFNGAHIPGSPFKIRVGEQSQAGDPGLVSAYGPGLEGGTTGVSSEFIVNTLNAGSGALSVTIDGPSKVQLDCRECPEGHVVTYTPMAPGNYLIAIKYGGPQHIVGSPFKAKVTGPRLSGGHSLHETSTVLVETVTKSSSSRGSSYSSIPKFSSDASKVVTRGPGLSQAFVGQKNSFTVDCSKAGTNMMMVGVHGPKTPCEEVYVKHMGNRVYNVTYTVKEKGDYILIVKWGDESVPGSPFKVKVP

SEQ ID NO: 369 - DNA, 1635 bp, Homo sapiens
aactctatatagggagttcaactggtcacccagagctgtcctgtggcctctgcagctcagcatggctagggtactgggagcacccgttgcactggggttgtggagcctatgctggtctctggccattgccacccctcttcctccgactagtgcccatgggaatgttgctgaaggcgagaccaagccagacccagacgtgactgaacgctgctcagatggctggagctttgatgctaccaccctggatgacaatggaaccatgctgttttttaaaggggagtttgtgtggaagagtcacaaatgggaccgggagttaatctcagagagatggaagaatttccccagccctgtggatgctgcattccgtcaaggtcacaacagtgtctttctgatcaagggggacaaagtctgggtataccctcctgaaaagaaggagaaaggatacccaaagttgctccaagatgaatttcctggaatcccatccccactggatgcagctgtggaatgtcaccgtggagaatgtcaagctgaaggcgtcctcttcttccaaggtgaccgcgagtggttctgggacttggctacgggaaccatgaaggagcgttcctggccagctgttgggaactgctcctctgccctgagatggctgggccgctactactgcttccagggtaaccaattcctgcgcttcgaccctgtcaggggagaggtgcctcccaggtacccgcgggatgtccgagactacttcatgccctgccctggcagaggccatggacacaggaatgggactggccatgggaacagtacccaccatggccctgagtatatgcgctgtagcccacatctagtcttgtctgcactgacgtctgacaaccatggtgccacctatgccttcagtgggacccactactggcgtctggacaccagccgggatggctggcatagctggcccattgctcatcagtggccccagggtccttcagcagtggatgctgccttttcctgggaagaaaaactctatctggtccagggcacccaggtatatgtcttcctgacaaagggaggctataccctagtaagcggttatccgaagcggctggagaaggaagtcgggacccctcatgggattatcctggactctgtggatgcggcctttatctgccctgggtcttctcggctccatatcatggcaggacggcggctgtggtggctggacctgaagtcaggagcccaagccacgtggacagagcttccttggccccatgagaaggtagacggagccttgtgtatggaaaagtcccttggccctaactcatgttccgccaatggtcccggcttgtacctcatccatggtcccaatttgtactgctacagtgatgtggagaaactgaatgcagccaaggcccttccgcaaccccagaatgtgaccagtctcctgggctgcactcactgaggggccttctgacatgagtctggcctggccccacctcctagttcctcataataaagacagattgcttcttcgcttctcactgaggggccttctgacatgagtctggcctggccccacctccccagtttctcataataaagacagattgcttcttcacttgaatcaagggacctaaaaaaaaaaaa

SEQ ID NO: 370 - protein, 462 aa, Homo sapiens
MARVLGAPVALGLWSLCWSLAIATPLPPTSAHGNVAEGETKPDPDVTERCSDGWSFDATTLDDNGTMLFFKGEFVWKSHKWDRELISERWKNFPSPVDAAFRQGHNSVFLIKGDKVWVYPPEKKEKGYPKLLQDEFPGIPSPLDAAVECHRGECQAEGVLFFQGDREWFWDLATGTMKERSWPAVGNCSSALRWLGRYYCFQGNQFLRFDPVRGEVPPRYPRDVRDYFMPCPGRGHGHRNGTGHGNSTHHGPEYMRCSPHLVLSALTSDNHGATYAFSGTHYWRLDTSRDGWHSWPIAHQWPQGPSAVDAAFSWEEKLYLVQGTQVYVFLTKGGYTLVSGYPKRLEKEVGTPHGIILDSVDAAFICPGSSRLHIMAGRRLWWLDLKSGAQATWTELPWPHEKVDGALCMEKSLGPNSCSANGPGLYLIHGPNLYCYSDVEKLNAAKALPQPQNVTSLLGCTH

SEQ ID NO: 371 - DNA, 8434 bp, Homo sapiens
ggaagagttctagcctgaaagggaactcgggcgtcgtcctggcgtcctctccggattgcgccgcaccctcgcttcctgccagggaggggctgccgggctttggcggctcccgagcatcgagaacggggccagagcagcttcctgcctgccccccgcgaccatagagcgcgggcccagggcgccgcccgcgggtgggggacgttcccaggacggaagtggccgagagagtgtcgaagggagggcgaggccggagcccgagggcgacccgagaagcggcggggcggcgggccggcgggcggggcgcagagccaggcagcgcaggtatagccaggctggagaaaagaagctgccaccatggttgcactttcactgaagatcagcattgggaatgtggtgaagacgatgcagtttgagccgtctaccatggtgtacgacgcctgccgcatcattcgtgagcggatcccagaggccccagctggtcctcccagcgactttgggctctttctgtcagatgatgaccccaaaaagggtatatggctggaggctgggaaagctttggactactacatgctccgaaatggggacactatggagtacaggaagaaacagagacccctgaagatccgtatgctggatggaactgtgaagacgatcatggtggatgactctaagactgtcactgacatgctcatgaccatctgtgcccgcattggcatcaccaatcatgatgaatattcattggttcgagagctgatggaagagaaaaaggaggaaataacagggaccttaagaaaggacaagacattgctgcgagatgaaaagaagatggagaaactaaagcagaaattgcacacagatgatgagttgaactggctggaccatggtcggacactgagggagcagggtgtagaggagcacgagacgctgctgctgcggaggaagttcttttactcagaccagaatgtggattcccgggaccctgtacagctgaacctcctgtatgtgcaggcacgagatgacatcctgaatggctcccaccctgtctcctttgacaaggcctgtgagtttgctggcttccaatgccagatccagtttgggccccacaatgagcagaagcacaaggctggcttccttgacctgaaggacttcctgcccaaggagtatgtgaagcagaagggagagcgtaagatcttccaggcacacaagaattgtgggcagatgagtgagattgaggccaaggtccgctacgtgaagctagcccgttctctcaagacttacggtgtctccttcttcctggtgaaggaaaaaatgaaagggaagaacaagctagtgcccaggcttctgggcatcaccaaggagtgtgtgatgcgagtggatgagaagaccaaggaagtgatccaggagtggaacctcaccaacatcaaacgctgggctgcgtctcccaaaagcttcaccctggattttggagattaccaagatggctattactcagtacagacaactgaaggggagcagattgcacagctcattgccggctacatcgatatcatcctgaagaagaaaaaaagcaaggatcactttgggctggaaggagatgaggagtctactatgctggaggactcagtgtcccccaaaaagtcaacagtcctgcagcagcaatacaaccgggtggggaaagtggagcatggctctgtggccctgcctgccatcatgcgctctggagcctctggtcctgagaatttccaggtgggcagcatgccccctgcccagcagcagattaccagcggccagatgcaccgaggacacatgcctcctctgacttcagcccagcaggcactcactggaaccattaactccagcatgcaggccgtgcaggctgcccaggccaccctggatgactttgacactctgccgcctcttggccaggatgctgcctctaaggcctggcgtaaaaacaagatggatgaatcaaagcatgagatccactctcaggtagatgccatcacagctggtactgcgtctgtggtgaacctgacagcaggggaccctgctgagacagactataccgcagtgggctgtgcagtcaccacaatctcctccaacctgacggagatgtcccgtggggtgaagctgctggctgccttgctggaggacgaaggcggcagtggtcggcccctgttgcaggcagcaaagggccttgcgggagcagtgtcagaactgctgcgcagtgcccaaccagccagtgctgagccccgtcagaacctgctgcaagcagctgggaacgtgggccaggccagtggggagctgttgcaacaaattggggaaagtgatactgacccccacttccaggatgcgctaatgcagctcgccaaagctgtggcaagtgctgcagctgccctggtcctcaaggccaagagtgtggcccagcggacagaggactcgggacttcagacccaagttattgctgcagcaacacagtgtgccctatccacttcccaactagtggcctgtactaaggtggtggcacctacaatcagctcacctgtctgccaagagcaactggtggaggctggacgactggtagccaaagccgtggagggctgtgtgtctgcctcccaggcagctacagaggatgggcaactgttgcgaggggtaggagcagcagccacagctgtcacccaggccctaaatgagctgctgcagcatgtgaaagcccatgccacaggggctgggcctgctggccgttatgaccaggctactgacaccatcctaaccgtcactgagaacatctttagctccatgggtgatgctggggagatggtgcgacaggcccgcatcctggcccaagccacatctgacctggtcaatgccatcaaggctgatgctgagggggaaagtgatctggagaactcccgcaagctcttaagtgctgccaagatcctagctgatgccacagccaagatggtagaggctgccaagggagcagctgcccaccctgacagtgaggagcagcagcagcggctgcgggaggcagctgaggggctgcgcatggccaccaatgcagctgcgcagaatgccatcaagaaaaagctggtgcagcgcctggagcatgcagccaagcaggctgcagcctcagccacacagaccatcgctgcagctcagcacgcagcctctacccccaaggcctctgccggcccccagcccctgctggtgcagagctgcaaggcagtggcagagcagattccactgctggtgcagggcgtccgaggaagccaagcccagcctgacagccccagcgctcagcttgccctcattgctgccagccagagcttcctgcagccaggtgggaagatggtggcagctgcaaaggcctcagtgccaacgattcaggaccaggcttcagccatgcagctgagtcagtgtgccaagaacctgggcaccgcgctggctgaactccggacggctgcccagaaggctcaggaagcatgtggacctttggagatggattctgcactgagtgtggtacagaatctagagaaagatctacaggaagtgaaggcagcagctcgagatggcaagcttaaacccttacctggggagacaatggagaagtgtacccaggacctgggcaacagcaccaaagccgtgagctcagccatcgcccagctactgggagaggttgcccagggcaatgagaattatgcaggtattgcagctcgggatgtggcaggtgggctgcggtcactggcccaggccgctaggggagtcgctgcactgacgtcagatcctgcagtgcaggccattgtacttgatacggccagtgatgtgctggacaaggccagcagcctcattgaggaggcgaaaaaggcagctggccatccaggggaccctgagagccagcagcggcttgcccaggtggctaaagcagtgacccaggctctgaaccgctgtgtcagctgcctacctggccagcgcgatgtggataatgccctgagggcagttggagatgccagcaagcgactcctgagtgactcgcttcctcctagcactgggacatttcaagaagctcagagccggttgaatgaagctgctgctgggctgaatcaggcagccacagaactggtgcaggcctctcggggaacccctcaggacctggctcgagcctcaggccgatttggacaggacttcagcaccttcctggaagctggtgtggagatggcaggccaggctccgagccaggaggaccgagcccaagttgtgtccaacttgaagggcatctccatgtcttcaagcaaacttcttctggctgccaaggccctgtccacggaccctgctgcccctaacctcaagagtcagctggctgcagctgccagggcagtaactgacagcatcaatcagctcatcactatgtgcacccagcaggcacccggccagaaggagtgtgataacgccctgcgggaattggagacggtccgggaactcctggagaacccagtccagcccatcaatgacatgtcctactttggttgcctggacagtgtaatggagaactcaaaggtgctgggcgaggccatgactggcatctcccaaaatgccaagaacggaaacctgccagagtttggagatgccatttccacagcctcaaaggcactttgtggcttcaccgaggcagctgcacaggctgcatatctggttggtgtctctgaccccaatagccaagctggacagcaagggctagtggagcccacacagtttgcccgtgcaaaccaggcaattcagatggcctgccagagtttgggagagcctggctgtacccaggcccaggtgctctctgcagccaccattgtggctaaacacacctctgcactgtgtaacagctgtcgcctggcttctgcccgtaccaccaatcctactgccaagcgccagtttgtacagtcagccaaggaggtggccaacagcacagctaatcttgtcaagaccatcaaggcgctagatggggccttcacagaggagaaccgtgcccagtgccgagcagcaacagcccctctgctggaggctgtggacaatctgagtgcctttgcgtccaaccctgagttctccagcattcctgcccagatcagccctgagggtcgggctgccatggagcccattgtgatctctgccaagacaatgttagagagtgccgggggactcatccagacagcccgggccctcgcagtcaatccccgggaccccccgagctggtcggtgctggccggccactcccgtactgtctcagactccatcaagaagctaattacaagcatgagggacaaggctccagggcagctggagtgtgaaacggccattgcagctctgaacagttgtctacgggacctagaccaggcttccctcgctgcagtcagccagcagcttgctccccgtgagggaatctctcaagaggccttgcacactcagatgctcactgcagtccaagagatctcccatctcattgagccgctggccaatgctgcccgggctgaagcctcccagctgggacacaaggtgtcccagatggcgcagtactttgagccgctcaccctggctgcagtgggtgctgcctccaagaccctgagccacccgcagcagatggcactcctggaccagactaaaacattggcagagtctgccctgcagttgctatacactgccaaggaggctggtggtaacccaaagcaagcagctcacacccaggaagccctggaggaggctgtgcagatgatgaccgaggccgtagaggacctgacaacaaccctcaacgaggcagccagtgctgctggggtcgtgggtggcatggtggactccatcacccaggccatcaaccagctagatgaaggaccaatgggtgaaccagaaggttccttcgtggattaccaaacaactatggtgcggacagccaaggccattgcagtgaccgttcaggagatggttaccaagtcaaacaccagcccagaggagctgggccctcttgctaaccagctgaccagtgactatggccgtctggcctcggaggccaagcctgcagcggtggctgctgaaaatgaagagataggttcccatatcaaacaccgggtacaggagctgggccatggctgtgccgctctggtcaccaaggcaggcgccctgcagtgcagccccagtgatgcctacaccaagaaggagctcatagagtgtgcccggagagtctctgagaaggtctcccacgtcctggctgcgctccaggctgggaatcgtggcacccaggcctgcatcacagcagccagcgctgtgtctggtatcattgctgacctcgacaccaccatcatgttcgccactgctggcacgctcaatcgtgagggtactgaaactttcgctgaccaccgggagggcatcctgaagactgcgaaggtgctggtggaggacaccaaggtcctggtgcaaaacgcagctgggagccaggagaagttggcgcaggctgcccagtcctccgtggcgaccatcacccgcctcgctgatgtggtcaagctgggtgcagccagcctgggagctgaggaccctgagacccaggtggtactaatcaacgcagtgaaagatgtagccaaagccctgggagacctcatcagtgcaacgaaggctgcagctggcaaagttggagatgaccctgctgtgtggcagctaaagaactctgccaaggtgatggtgaccaatgtgacatcattgcttaagacagtaaaagccgtggaagatgaggccaccaaaggcactcgggccctggaggcaaccacagaacacatacggcaggagctggcggttttctgttccccagagccacctgccaagacctctaccccagaagacttcatccgaatgaccaagggtatcaccatggcaaccgccaaggccgttgctgctggcaattcctgtcgccaggaagatgtcattgccacagccaatctgagccgccgtgctattgcagatatgcttcgggcttgcaaggaagcagcttaccacccagaagtggcccctgatgtgcggcttcgagccctgcactatggccgggagtgtgccaatggctacctggaactgctggaccatgtactgctgaccctgcagaagccaagcccagaactgaagcagcagttgacaggacattcaaagcgtgtggctggttccgtcactgagctcatccaggctgctgaagccatgaagggaacagaatgggtagacccagaggaccccacagtcattgctgagaatgagctcctgggagctgcagccgccattgaggctgcagccaaaaagctagagcagctgaagccccgggccaaacccaaggaggcagatgagtccttgaactttgaggagcagatactagaagctgccaagtccattgcagcagccaccagtgcactggtaaaggctgcgtcggctgcccagagagaactagtggcccaagggaaggtgggtgccattccagccaatgcactggacgatgggcagtggtcccagggcctcatttctgctgcccggatggtggctgcggccaccaacaatctgtgtgaggcagccaatgcagctgtacaaggccatgccagccaggagaagctcatctcatcagccaagcaggtagctgcctccacagcccagctccttgtggcctgcaaggtcaaggctgaccaggactcggaggcaatgaaacgacttcaggctgctggcaacgcagtgaagcgagcctcagataatctggtgaaagcagcacagaaggctgcagcctttgaagagcaggagaatgagacagtggtggtgaaagagaagatggttggcggcattgcccagatcatcgcagcacaggaagaaatgcttcggaaggaacgagagctggaagaggcgcggaagaaactggcccagatccggcagcagcagtacaagtttctgccttcagagcttcgagatgagcactaaagaagcctcttctatttaatgcagacccggcccagagactgtgcgtgccactaccaaagccttctgggctgtcggggcccaacctgcccaaccccagcactccccaaagtgcctgccaaaccccagggcctggccccgcccagtcccgcagtacatcccctgtcccctccccaaccccaagtgccttcatgccctagggccccccaagtgcctgcccctccccagagtattaacgctccaagagtattattaacgctgctgtacctcgatctgaatctgccggggccccagcccactccaccctgccagcagcttccggccagtccccacagcctcatcagctctcttcaccgttttttgatactatcttcccccacccccagctacccataggggctgcagagttataagccccaaacaggtcatgctccaataaaaatgattctacctacaa

SEQ ID NO: 372 - protein, 2541 aa, Homo sapiens
MVALSLKISIGNVVKTMQFEPSTMVYDACRIIRERIPEAPAGPPSDFGLFLSDDDPKKGIWLEAGKALDYYMLRNGDTMEYRKKQRPLKIRMLDGTVKTIMVDDSKTVTDMLMTICARIGITNHDEYSLVRELMEEKKEEITGTLRKDKTLLRDEKKMEKLKQKLHTDDELNWLDHGRTLREQGVEEHETLLLRRKFFYSDQNVDSRDPVQLNLLYVQARDDILNGSHPVSFDKACEFAGFQCQIQFGPHNEQKHKAGFLDLKDFLPKEYVKQKGERKIFQAHKNCGQMSEIEAKVRYVKLARSLKTYGVSFFLVKEKMKGKNKLVPRLLGITKECVMRVDEKTKEVIQEWNLTNIKRWAASPKSFTLDFGDYQDGYYSVQTTEGEQIAQLIAGYIDIILKKKKSKDHFGLEGDEESTMLEDSVSPKKSTVLQQQYNRVGKVEHGSVALPAIMRSGASGPENFQVGSMPPAQQQITSGQMHRGHMPPLTSAQQALTGTINSSMQAVQAAQATLDDFDTLPPLGQDAASKAWRKNKMDESKHEIHSQVDAITAGTASVVNLTAGDPAETDYTAVGCAVTTISSNLTEMSRGVKLLAALLEDEGGSGRPLLQAAKGLAGAVSELLRSAQPASAEPRQNLLQAAGNVGQASGELLQQIGESDTDPHFQDALMQLAKAVASAAAALVLKAKSVAQRTEDSGLQTQVIAAATQCALSTSQLVACTKVVAPTISSPVCQEQLVEAGRLVAKAVEGCVSASQAATEDGQLLRGVGAAATAVTQALNELLQHVKAHATGAGPAGRYDQATDTILTVTENIFSSMGDAGEMVRQARILAQATSDLVNAIKADAEGESDLENSRKLLSAAKILADATAKMVEAAKGAAAHPDSEEQQQRLREAAEGLRMATNAAAQNAIKKKLVQRLEHAAKQAAASATQTIAAAQHAASTPKASAGPQPLLVQSCKAVAEQIPLLVQGVRGSQAQPDSPSAQLALIAASQSFLQPGGKMVAAAKASVPTIQDQASAMQLSQCAKNLGTALAELRTAAQKAQEACGPLEMDSALSVVQNLEKDLQEVKAAARDGKLKPLPGETMEKCTQDLGNSTKAVSSAIAQLLGEVAQGNENYAGIAARDVAGGLRSLAQAARGVAALTSDPAVQAIVLDTASDVLDKASSLIEEAKKAAGHPGDPESQQRLAQVAKAVTQALNRCVSCLPGQRDVDNALRAVGDASKRLLSDSLPPSTGTFQEAQSRLNEAAAGLNQAATELVQASRGTPQDLARASGRFGQDFSTFLEAGVEMAGQAPSQEDRAQVVSNLKGISMSSSKLLLAAKALSTDPAAPNLKSQLAAAARAVTDSINQLITMCTQQAPGQKECDNALRELETVRELLENPVQPINDMSYFGCLDSVMENSKVLGEAMTGISQNAKNGNLPEFGDAISTASKALCGFTEAAAQAAYLVGVSDPNSQAGQQGLVEPTQFARANQAIQMACQSLGEPGCTQAQVLSAATIVAKHTSALCNSCRLASARTTNPTAKRQFVQSAKEVANSTANLVKTIKALDGAFTEENRAQCRAATAPLLEAVDNLSAFASNPEFSSIPAQISPEGRAAMEPIVISAKTMLESAGGLIQTARALAVNPRDPPSWSVLAGHSRTVSDSIKKLITSMRDKAPGQLECETAIAALNSCLRDLDQASLAAVSQQLAPREGISQEALHTQMLTAVQEISHLIEPLANAARAEASQLGHKVSQMAQYFEPLTLAAVGAASKTLSHPQQMALLDQTKTLAESALQLLYTAKEAGGNPKQAAHTQEALEEAVQMMTEAVEDLTTTLNEAASAAGVVGGMVDSITQAINQLDEGPMGEPEGSFVDYQTTMVRTAKAIAVTVQEMVTKSNTSPEELGPLANQLTSDYGRLASEAKPAAVAAENEEIGSHIKHRVQELGHGCAALVTKAGALQCSPSDAYTKKELIECARRVSEKVSHVLAALQAGNRGTQACITAASAVSGIIADLDTTIMFATAGTLNREGTETFADHREGILKTAKVLVEDTKVLVQNAAGSQEKLAQAAQSSVATITRLADVVKLGAASLGAEDPETQVVLINAVKDVAKALGDLISATKAAAGKVGDDPAVWQLKNSAKVMVTNVTSLLKTVKAVEDEATKGTRALEATTEHIRQELAVFCSPEPPAKTSTPEDFIRMTKGITMATAKAVAAGNSCRQEDVIATANLSRRAIADMLRACKEAAYHPEVAPDVRLRALHYGRECANGYLELLDHVLLTLQKPSPELKQQLTGHSKRVAGSVTELIQAAEAMKGTEWVDPEDPTVIAENELLGAAAAIEAAAKKLEQLKPRAKPKEADESLNFEEQILEAAKSIAAATSALVKAASAAQRELVAQGKVGAIPANALDDGQWSQGLISAARMVAAATNNLCEAANAAVQGHASQEKLISSAKQVAASTAQLLVACKVKADQDSEAMKRLQAAGNAVKRASDNLVKAAQKAAAFEEQENETVVVKEKMVGGIAQIIAAQEEMLRKERELEEARKKLAQIRQQQYKFLPSELRDEH

SEQ ID NO: 373 - DNA, 829 bp, Homo sapiens
tggggagtgaaagcgaaagcccgggcgactagccgggagaccagagatctagcgactgaagcagcatggccaagccgtgtggggtgcgcctgagcggggaagcccgcaaacaggtggaggtcttcagacagaatcttttccaggaggctgaggaattcctctacagattcttgccacagaaaatcatatacctgaatcagctcttgcaagaggactccctcaatgtggctgacttgacttccctccgggccccactggacatccccatcccagaccctccacccaaggatgatgagatggaaacagataagcaggagaagaaagaagtccataagtgtggatttctccctgggaatgagaaagtcctgtccctgcttgccctggttaagccagaagtctggactctcaaagagaaatgcattctggtgattacatggatccaacacctgatccccaagattgaagatggaaatgattttggggtagcaatccaggagaaggtgctggagagggtgaatgccgtcaagaccaaagtggaagctttccagacaaccatttccaagtacttctcagaacgtggggatgctgtggccaaggcctccaaggagactcatgtaatggattaccgggccttggtgcatgagcgagatgaggcagcctatggggagctcagggccatggtgctggacctgagggccttctatgctgagctttatcatatcatcagcagcaacctggagaaaattgtcaacccaaagggtgaagaaaagccatctatgtactgaacccgggactagaaggaaaataaatgatctatatgttgtgtgga

SEQ ID NO: 374 - protein, 239 aa, Homo sapiens
MAKPCGVRLSGEARKQVEVFRQNLFQEAEEFLYRFLPQKIIYLNQLLQEDSLNVADLTSLRAPLDIPIPDPPPKDDEMETDKQEKKEVHKCGFLPGNEKVLSLLALVKPEVWTLKEKCILVITWIQHLIPKIEDGNDFGVAIQEKVLERVNAVKTKVEAFQTTISKYFSERGDAVAKASKETHVMDYRALVHERDEAAYGELRAMVLDLRAFYAELYHIISSNLEKIVNPKGEEKPSMY

SEQ ID NO: 375 - DNA, 2545 bp, Homo sapiens
gtgctggggagcagcgtgtttactgtgcttggtcatgagctgctgggaagttgtgactttcactttccctttcgaattccagggtatatctgggaggccggaggacgtgtctggttattacacagatgcacagctggacgtgggatccacacagctcagaacagttggatcttgctcagtctctgtcagaggaagatcccttggacaagaggaccctgccttggtgtgagagtgagggaagaggaagctggaacgagggttaaggaaaaccttccagtctggacagtgactggagagctccaaggaaagcccctcggtaacccagccgctggcaccatgaacccagagagcagtatctttattgaggattaccttaagtatttccaggaccaagtgagcagagagaatctgctacaactgctgactgatgatgaagcctggaatggattcgtggctgctgctgaactgcccagggatgaggcagatgagctccgtaaagctctgaacaagcttgcaagtcacatggtcatgaaggacaaaaaccgccacgataaagaccagcagcacaggcagtggtttttgaaagagtttcctcggttgaaaagggagcttgaggatcacataaggaagctccgtgcccttgcagaggaggttgagcaggtccacagaggcaccaccattgccaatgtggtgtccaactctgttggcactacctctggcatcctgaccctcctcggcctgggtctggcacccttcacagaaggaatcagttttgtgctcttggacactggcatgggtctgggagcagcagctgctgtggctgggattacctgcagtgtggtagaactagtaaacaaattgcgggcacgagcccaagcccgcaacttggaccaaagcggcaccaatgtagcaaaggtgatgaaggagtttgtgggtgggaacacacccaatgttcttaccttagttgacaattggtaccaagtcacacaagggattgggaggaacatccgtgccatcagacgagccagagccaaccctcagttaggagcgtatgccccacccccgcatatcattgggcgaatctcagctgaaggcggtgaacaggttgagagggttgttgaaggccccgcccaggcaatgagcagaggaaccatgatcgtgggtgcagccactggaggcatcttgcttctgctggatgtggtcagccttgcatatgagtcaaagcacttgcttgagggggcaaagtcagagtcagctgaggagctgaagaagcgggctcaggagctggaggggaagctcaactttctcaccaagatccatgagatgctgcagccaggccaagaccaatgaccccagagcagtgcagccaccagggcagaaatgccgggcacaggccaggacaaaatgcagacttttttttttttttttttttttttttgagatggagtctcgctctatcgcccaggatggagtgcagtggctcaatctcggctcactgcaaactccgcctcccgggttcacaccattctccggcctcagtctcccgagtagctgggactacaggcacctgccaccacgcccggctaatttttttgtattttcactggagacggggtttcactgtgttagccacgatggtctccatctcctgacctcgtgatctgcccacctcggcctcccaaagtgctgggattacaggcgtgagccaccgcgcctggccaaaatgcagacattttattagggggataaggagggcaaggtaaagcttatggaactgagtgttagtgactttggcatttgtgtagctgagcacagcaagggaggggttaatgcagatggcaagtgcaccaaggagaaggcaggaacactggagcctgcaataagggaggagagaggactggagagtgtggggaatgggaagaagtagtttactttggactaaagaatatattgggcgaagaatagagggggagcttgcaggaaccagcaatgagaaggccaggaaaagaaagagctgaaaatggagaaaaccagagttagaactgttggatacaggagaagaaacagcagctccactaccgacccccccccaggtttgatgtccttccaagaataaagtctttccctggtgatggtctctcgctctgtctttccagcatccactctcccttgtccttctgggggtgtatcacagtcagccagtggcttcttcatgatggtggttggggtggttgtcatgtgacgggtcccctccaggttactaaagggtgcatgtcccctgcttgaaccctgagaggcaggtggtaggccatggccacaatccccagctgaggagcaggtgtccctgagaacccaaacttcccagagagtatctgagaaccaaccaatgaaaacagtcccatcgctcttagccggtaagtaaacagtcagaagattagcatgaaagcagtttagcattgggaggaagcacagatctctagagctgtcctgtcgctgcccaggattgacctgtgtgtaagtcccaataaactcacctactcaccaa

SEQ ID NO: 376 - protein, 337 aa, Homo sapiens
MNPESSIFIEDYLKYFQDQVSRENLLQLLTDDEAWNGFVAAAELPRDEADELRKALNKLASHMVMKDKNRHDKDQQHRQWFLKEFPRLKRELEDHIRKLRALAEEVEQVHRGTTIANVVSNSVGTTSGILTLLGLGLAPFTEGISFVLLDTGMGLGAAAAVAGITCSVVELVNKLRARAQARNLDQSGTNVAKVMKEFVGGNTPNVLTLVDNWYQVTQGIGRNIRAIRRARANPQLGAYAPPPHIIGRISAEGGEQVERVVEGPAQAMSRGTMIVGAATGGILLLLDVVSLAYESKHLLEGAKSESAEELKKRAQELEGKLNFLTKIHEMLQPGQDQ

SEQ ID NO: 377 - DNA, 1947 bp, Homo sapiens
gctgaacttccggcctcaggacgcaggcgcgggccgctcatttcgctctttccggcggtgctcgcaagcgaggcagccatgtcttatcccgctgatgattatgagtctgaggcggcttatgacccctacgcttatcccagcgactatgatatgcacacaggagatccaaagcaggaccttgcttatgaacgtcagtatgaacagcaaacctatcaggtgatccctgaggtgatcaaaaacttcatccagtatttccacaaaactgtctcagatttgattgaccagaaagtgtatgagctacaggccagtcgtgtctccagtgatgtcattgaccagaaggtgtatgagatccaggacatctatgagaacagctggaccaagctgactgaaagattcttcaagaatacaccttggcccgaggctgaagccattgctccacaggttggcaatgatgctgtcttcctgattttatacaaagaattatactacaggcacatatatgccaaagtcagttttcagtcattcagtcagtaccgctgtaagactgccaagaagtcagaggaggagattgactttcttcgttccaatcccaaaatctggaatgttcatagtgtcctcaatgtccttcattccctggtagacaaatccaacatcaaccgacagttggaggtatacacaagcggaggtgaccctgagagtgtggctggggagtatgggcggcactccctctacaaaatgcttggttacttcagcctggtcgggcttctccgcctgcactccctgttaggagattactaccaggccatcaaggtgctggagaacatcgaactgaacaagaagagtatgtattcccgtgtgccagagtgccaggtcaccacatactattatgttgggtttgcatatttgatgatgcgtcgttaccaggatgccatccgggtcttcgccaacatcctcctctacatccagaggaccaagagcatgttccagaggaccacgtacaagtatgagatgattaacaagcagaatgagcagatgcatgcgctgctggccattgccctcacgatgtaccccatgcgtattgatgagagcattcacctccagctgcgggagaaatatggggacaagatgttgcgcatgcagaaaggtgacccacaagtctatgaagaacttttcagttactcctgccccaagttcctgtcgcctgtagtgcccaactatgataatgtgcaccccaactaccacaaagagcccttcctgcagcagctgaaggtgttttctgatgaagtacagcagcaggcccagctttcaaccatccgcagcttcctgaagctctacaccaccatgcctgtggccaagctggctggcttcctggacctcacagagcaggagttccggatccagcttcttgtcttcaaacacaagatgaagaacctcgtgtggaccagcggtatctcagccctggatggtgaatttcagtcagcctcagaggttgacttctacattgataaggacatgatccacatcgcggacaccaaggtcgccaggcgttatggggatttcttcatccgtcagatccacaaatttgaggagcttaatcgaaccctgaagaagatgggacagagaccttgatgatattcacacacattcaggaacctgttttgatgtattataggcaggaagtgtttttgctaccgtgaaacctttacctagatcagccatcagcctgtcaactcagttaacaagttaaggaccgaagtgtttcaagtggatctcagtaaaggatctttggagccagatttgtcgtctcattattgtaggagagaatttgtgggttgtggcagtaatacatttcccatgtgtcctgatgctttcaggatacatcagttgttagtgtttaaattgagttatttttattttgtgcttttgagatggagtctcactctgtct

SEQ ID NO: 378 - protein, 516 aa, Homo sapiens
MSYPADDYESEAAYDPYAYPSDYDMHTGDPKQDLAYERQYEQQTYQVIPEVIKNFIQYFHKTVSDLIDQKVYELQASRVSSDVIDQKVYEIQDIYENSWTKLTERFFKNTPWPEAEAIAPQVGNDAVFLILYKELYYRHIYAKVSFQSFSQYRCKTAKKSEEEIDFLRSNPKIWNVHSVLNVLHSLVDKSNINRQLEVYTSGGDPESVAGEYGRHSLYKMLGYFSLVGLLRLHSLLGDYYQAIKVLENIELNKKSMYSRVPECQVTTYYYVGFAYLMMRRYQDAIRVFANILLYIQRTKSMFQRTTYKYEMINKQNEQMHALLAIALTMYPMRIDESIHLQLREKYGDKMLRMQKGDPQVYEELFSYSCPKFLSPVVPNYDNVHPNYHKEPFLQQLKVFSDEVQQQAQLSTIRSFLKLYTTMPVAKLAGFLDLTEQEFRIQLLVFKHKMKNLVWTSGISALDGEFQSASEVDFYIDKDMIHIADTKVARRYGDFFIRQIHKFEELNRTLKKMGQRP

SEQ ID NO: 379 - DNA, 1955 bp, Homo sapiens
gcgggcggggcctctggggcggagcggccaccatcttggaacgggaggcggagcagagtcgactgggagcgaccgagcgggccgccgccgccgccatgaaccccgaatatgactacctgtttaagctgcttttgattggcgactcaggcgtgggcaagtcatgcctgctcctgcggtttgctgatgacacgtacacagagagctacatcagcaccatcggggtggacttcaagatccgaaccatcgagctggatggcaaaactatcaaacttcagatctgggacacagcgggccaggaacggttccggaccatcacttccagctactaccggggggctcatggcatcatcgtggtgtatgacgtcactgaccaggaatcctacgccaacgtgaagcagtggctgcaggagattgaccgctatgccagcgagaacgtcaataagctcctggtgggcaacaagagcgacctcaccaccaagaaggtggtggacaacaccacagccaaggagtttgcagactctctgggcatccccttcttggagacgagcgccaagaatgccaccaatgtcgagcaggcgttcatgaccatggctgctgaaatcaaaaagcggatggggcctggagcagcctctgggggcgagcggcccaatctcaagatcgacagcacccctgtaaagccggctggcggtggctgttgctaggaggggcacatggagtgggacaggagggggcaccttctccagatgatgtccctggagggggcaggaggtacctccctctccctctcctggggcatttgagtctgtggctttggggtgtcctgggctccccatctccttctggcccatctgcctgctgccctgagccccggttctgtcagggtccctaagggaggacactcagggcctgtggccaggcagggcggaggcctgctgtgctgttgcctctaggtgactttccaagatgcccccctacacacctttctttggaacgagggctcttctgtcggtgtccctcccacccccatgtatgctgcactgggttctctccttcttcttcctgctgtcctgcccaagaactgagggtctccccggcctctactgccctggctgcagtcagtgcccagggcgaggaatgtggccaggggatccaggacctgggatccagggccctgggctggacctcaggacaggcatggaggccacaggggcccagcagcccaccctttcctctccccactgcctcctctcccttcctacactcccagctcgagccgtccagctgcggtgggatctgagtatatctagggcgggtgggcgggtagcagtgctgggcctgtgtcttgagcctggagggagtctgctcctgccgccctctgccctgccagagacagacccatgcgctgcctgcccaccgtgcccctttgtccccatgtcaggcggaggcggaaggcccaccgtgccagaggctgggcaccagccttaaccctcactctgctagcacctcctccctttccccaaggtagcacatctggctcactccccactccgtctctggagcccaccagggaaggccctcatcccctgccgctacttctctggggaatgtgggttccatccaggattgggggcctctctgctcacccactctgcacccaggatcctagtcccctgccctctggcacagctgcttcctgcaagaaagcaagtctttggtctccctgagaagccatgtccctcgtgctgtctcttgcctgtcccacctgtgccctgccctccagcttgtatttaagtccctgggctgcccccttggggtgccccccgctcccaggttcccctctggtgtcatgtcaggcattttgcaaggaaaagccacttggggaaagatggaaaaggacaaaaaaaattaataaatttccattggccctcgggtgagctgagggtttttgcaaggaa

SEQ ID NO: 380 - protein, 201 aa, Homo sapiens
MNPEYDYLFKLLLIGDSGVGKSCLLLRFADDTYTESYISTIGVDFKIRTIELDGKTIKLQIWDTAGQERFRTITSSYYRGAHGIIVVYDVTDQESYANVKQWLQEIDRYASENVNKLLVGNKSDLTTKKVVDNTTAKEFADSLGIPFLETSAKNATNVEQAFMTMAAEIKKRMGPGAASGGERPNLKIDSTPVKPAGGGCC

SEQ ID NO: 381 - DNA, 829 bp, Homo sapiens
cctcttttccgtggcgcctcggaggcgttcagctgcttcaagatgaagctgaacatctccttcccagccactggctgccagaaactcattgaagtggacgatgaacgcaaacttcgtactttctatgagaagcgtatggccacagaagttgctgctgacgctctgggtgaagaatggaagggttatgtggtccgaatcagtggtgggaacgacaaacaaggtttccccatgaagcagggtgtcttgacccatggccgtgtccgcctgctactgagtaaggggcattcctgttacagaccaaggagaactggagaaagaaagagaaaatcagttcgtggttgcattgtggatgcaaatctgagcgttctcaacttggttattgtaaaaaaaggagagaaggatattcctggactgactgatactacagtgcctcgccgcctgggccccaaaagagctagcagaatccgcaaacttttcaatctctctaaagaagatgatgtccgccagtatgttgtaagaaagcccttaaataaagaaggtaagaaacctaggaccaaagcacccaagattcagcgtcttgttactccacgtgtcctgcagcacaaacggcggcgtattgctctgaagaagcagcgtaccaagaaaaataaagaagaggctgcagaatatgctaaacttttggccaagagaatgaaggaggctaaggagaagcgccaggaacaaattgcgaagagacgcagactttcctctctgcgagcttctacttctaagtctgaatccagtcagaaataagattttttgagtaacaaataaataagatcagactctg

SEQ ID NO: 382 - protein, 249 aa, Homo sapiens
MKLNISFPATGCQKLIEVDDERKLRTFYEKRMATEVAADALGEEWKGYVVRISGGNDKQGFPMKQGVLTHGRVRLLLSKGHSCYRPRRTGERKRKSVRGCIVDANLSVLNLVIVKKGEKDIPGLTDTTVPRRLGPKRASRIRKLFNLSKEDDVRQYVVRKPLNKEGKKPRTKAPKIQRLVTPRVLQHKRRRIALKKQRTKKNKEEAAEYAKLLAKRMKEAKEKRQEQIAKRRRLSSLRASTSKSESSQK

SEQ ID NO: 383 - DNA, 1820 bp, Homo sapiens
gccggggccaggaggaggcgggcgcaggaggcgcgtgctcagtgtgctgggtaccaggcgactccgggacagggggtctcggccgtcggcgtcatggtttcgcgcgtgcagctcccgcctgagatccagctggctcagcgcctggcggggaatgagcaggtgacccgggaccgggcggtgaggaagctccggaaatacatcgtcgccaggactcagcgggccgcaggtggttttacgcacgacgagctgctgaaggtgtggaaaggactgttttattgcatgtggatgcaggacaagccactcctccaggaagaattaggaaggactatttcccagctcgttcatgcttttcagaccacggaggcgcagcacctgttccttcaggccttctggcagaccatgaatcgcgagtggacgggcattgacaggctgcgcctggataaattctacatgctcatgcggatggtcctgaacgagtccttgaaggttctgaagatgcaaggctgggaagaaagacagatcgaggagctgctagagctgctgatgactgagatcctgcaccccagcagccaggcccccaacggtgtgaagagccacttcatcgagatcttcctggaggagctgaccaaagtgggcgccgaggagcttacggcagaccagaacctgaagttcatcgaccccttctgcagaattgctgcccggaccaaggattccttggttttgaacaacatcactcgaggcatctttgagacgattgtggagcaggccccgcttgccattgaagacctcctgaatgaactggacacacaggatgaggaggtggcgtcggacagtgatgagtcctctgagggtggtgagcgtggagacgcgctgtcccagaagaggtctgagaagccgcccgcaggctccatctgcagggctgaacctgaggctggtgaggagcaggcaggtgacgacagggacagtggcggccccgttctccagtttgactacgaggcagttgctaacagactgtttgaaatggccagccgccagagcaccccttctcagaacagaaagcgtctctacaaagtgatccggaagctgcaggacctggcaggaggcattttccctgaagatgagatcccagagaaggcctgcaggcgcctgcttgaagggaggcggcagaagaagacgaagaagcagaagcgtctgctcaggttgcagcaggagagagggaaaggtgagaaggagcccccgagcccgggcatggagaggaagaggagcaggaggaggggtgtaggggccgaccccgaggcgcgggcagaggctggtgagcagccaggcacagctgagcgggccctgctccgagatcagcccaggggccgtggccagagaggggctcgccagagaaggaggacacctcggcccctgaccagtgcccgagcaaaggcggccaatgtccaggagccggagaagaagaagaaacgcagggagtgatgtggccgggccaaggacaggcagggagggaggccaggcctcgcttgcaccgcgggacgaggctgaccgggctgttctgtagactcaggaccgtggctccagaactcctgtgccaggcgggagggaagggcggcactggagagatgggcccatcattaggggccagcatcccaggaactggacctttccccagagcctccgcctgtggctgtgatgaccttgggccagaaggtcaaactccgaagactgaaactctgcctgcagcaggactggccgcccctgctgtggggggttcagaaaataaaatgccgcgcagcccttgccagggaaaaaaaaaaaaa

SEQ ID NO: 384 - protein, 461 aa, Homo sapiens
MVSRVQLPPEIQLAQRLAGNEQVTRDRAVRKLRKYIVARTQRAAGGFTHDELLKVWKGLFYCMWMQDKPLLQEELGRTISQLVHAFQTTEAQHLFLQAFWQTMNREWTGIDRLRLDKFYMLMRMVLNESLKVLKMQGWEERQIEELLELLMTEILHPSSQAPNGVKSHFIEIFLEELTKVGAEELTADQNLKFIDPFCRIAARTKDSLVLNNITRGIFETIVEQAPLAIEDLLNELDTQDEEVASDSDESSEGGERGDALSQKRSEKPPAGSICRAEPEAGEEQAGDDRDSGGPVLQFDYEAVANRLFEMASRQSTPSQNRKRLYKVIRKLQDLAGGIFPEDEIPEKACRRLLEGRRQKKTKKQKRLLRLQQERGKGEKEPPSPGMERKRSRRRGVGADPEARAEAGEQPGTAERALLRDQPRGRGQRGARQRRRTPRPLTSARAKAANVQEPEKKKKRRE

SEQ ID NO: 385 - DNA, 5582 bp, Homo sapiens
ggcgtggggggagcagatgccgctggctgccagcgggacgccggcgagcagagcgcagccgcgagggaggcgcgagggaggcgagccggagcccgagcactagcagcagccggagtcggcgtaaagcacccgggcgcagccggagccggtgccgcagctgcgatggccgtggccgtggggagaccgtctaatgaagagcttcgaaacttgtctttgtctggccatgtgggatttgacagcctccctgaccagctggtcaacaagtctacttctcaaggattctgtttcaacatcctttgtgttggtgagacaggcattggcaaatccacgttaatggacactttgttcaacaccaaatttgaaagtgacccagctactcacaatgaaccaggtgttcggttaaaagccagaagttatgagcttcaggaaagcaatgtacggctgaagttaaccattgttgacaccgtgggatttggagaccagataaataaagatgacagctataagccgatagtagaatatattgatgcccagttcgaggcctacctgcaagaggaattgaagattaaacgttctctcttcaactaccatgacacgaggatccatgcctgcctctactttattgcccctactggacattcactaaagtccctggatctggtcaccatgaaaaagctggacagtaaggtgaacatcattccaataattgcaaaagctgacaccattgccaagaatgaactgcacaaattcaagagtaagatcatgagtgaactggtcagcaatggggtccagatatatcagtttcccactgatgaagaaacggtggcagagattaacgcaacaatgagtgtccatctcccatttgcagtggttggcagcaccgaagaggtgaagattggcaacaagatggcaaaggccaggcagtacccctggggtgtggtgcaggttgagaatgaaaatcattgcgattttgtgaaacttcgagagatgctgatccgcgtgaacatggaggacttgcgagagcagactcacacccgccactatgaattgtaccgacgctgtaagcttgaagagatggggttcaaggacactgaccctgacagcaaacccttcagtcttcaggagacatatgaagcaaaaaggaatgaattcctgggagaactgcagaagaaagaagaagaaatgagacaaatgtttgttatgagagtgaaggagaaagaagctgaacttaaggaggcagagaaagagcttcacgagaagtttgaccttctaaagcggacacaccaagaagaaaagaagaaagtggaagacaagaagaaggagcttgaggaggaggtgaacaacttccagaagaagaaagcagcggctcagttactacagtcccaggcccagcaatctggggcccagcaaaccaagaaagacaaggataagaaaaatgcaagcttcacataaagcctggcaagccaaggatgttcccgcattcacctgcttttgcagtaatatcgtatctctgccatgtgtgttctttagttttattttattttattttatttttttacccttcctcaaacaccagtaactattattaactcgttttgctgaatgttgttgggtggtagaaaatgatagaacaagggaataaccgcgaatgctctgtgcagctggactctgtttccggaaagtaaatgatttgctttttatgcctgttctgaatggcagcacgaagcaggcctgttacttgtatgtcgctttggacagaggaaagtggggtaaaatgctacctgtacgtctgacatgaaaacttctcaccgcctcagcagctgaactaaaaacctgaatagccatgacaagagtttgcattttcttgatgattcatctccatgagtgcacaatccctgaactcactgtcttttctccacacttgtcctaagccaaggtagatttgtacgtagacagactggtgagcaagcattatattttatttttacccttgcatgacattttcattttaatcaataacattatttggcctgagcttgtgggtctgttcagactgtctcctctcatggtttgaaactgcatctgaatgcctgccttcaatcctggccaagttggagtagactggtatgagaaaactatgattagttcacatttactggtgcatccttgatcctctcacagatagaggtcttaaaggttggatcatgtaacattgcttagtagaagaatcttcttctaaggatgatgggctttctacagcctgcttaccactaacagtaaggaatctttcataaacacacctcagtttgttcccagtgggcttagagggaggacctgatgactgattccaggatacttgtacttctaataacatttttcatgaatcatgagaaaatttccacagatacttcccttagaaaatttgctataaactctgtatcattggtagcacaaatttgagcgaggccttgtcaattttaaggtggaaataggaaggaccacaacatgacccgtaagtcaagaaggtagacatttcatatccagcttccttgcttagtctcctttcagtatttggcaataaaagaaagaagaaatagaacagctgaagtctcaaatcattgtctggaattttcctcaccttggctagctccacctgctctttgtctaaggcccttgcctcatcagggattagaactggcccatatgccagaacctgtactaaatgcctaatttgtatggaagagtgcatatttaatctcttttctatactgctcctttctgatgcttatcctttcatctgtgtgattgttttttcccctctactaacaagatcctcccagctttctctctacatgtagaaaggataacatttctcatgaacccactgcccctctgcattttcctcactggttagagattaagtaaataggatagaatatgctgcgtctcccctgacacacactttcttttttgaatgagcaagtctccattttgatttcagcaaagattttttctccttttctttgtcctcaaccatacttagaggaaagaaggaatggtcttccatgaactgattatgcttaattaagcaaagtaaggaaattagtttcatggaagcctaaacaaagctggaatagaaactacacactagacacagcagtagtcatagtcttcacaggtttaggagctactggaccaacattcttgtttttgcttttgtttttttaaataattctagtctggagctaactgtggagcagccaaatagtagctggcatgttgattcaaaccatgggctgaatttgctcataggctgtgcatcagacaaaagcttgaatatttgtgttgtatgcttgttccaaccaccgcttgtgtgagcatttttgtggcttgtacagaaagtacacttttaaattgtctcttgcatcactaaaatttttttaaaatgagcataacaacgaaaggcatccagctgactttttgattccaagattattgattggattgacttttttgcattaaatttttcccagcaaaataaatcatatggcgagtcagggaataaaaagtcaaaagaaacaaatagaagcttttttttttaaaaaatgtattgcttctgaacttttttctgccactgctccctagccctgtttagtttgttattgctgcttttcttttttctttctgtatctatgcctttttttcacagtagtccttggctctgcacggaataaatgataccctcaaatctaattggatgtgctttcgcctttgcatgtaagtacggtagtaagaaacctttgagatctttctgacttttcaaaattagagaaagcaaatgggatggatagattttttttttcttttcaaggggggcaggaaggtaatggtttgagtagcctttgtttaaaaaaaagactaaatatatttaaaaggccacatttatatttttttcacaagaaccacataataaattccacttcttgacctgaatttggaaatccgaaattactaatccaggccaggtgtggtggctcatgcctgtaatcccagcactttgagaggccgaggtgggcagatcacttgaggcctggagttcaagaccaccttggcgaacacggtgaaaccccgtctctacaaaaaatacaaaaattagccaggcgtggtggcacgtgcctgtagtcccagctacttgggaggctaagtcaggagaattgcttgaacttgggagatggaggttgcagtgagccaagattgcaccactgcattccaacctgggtgatgaagtgagactctccaaaaaaaaaaaagaaattattaatccctgcctgtgctctacatagcctcatgggcatcattggatagctcagagggcccttgattctggcaaggcaaataaagccagaatgagaaattaccatcttctactagagaaaaccaagagaaaaatttttatgctaggatgcctttatgaccacttaattttttaatcttagtttaatggtctctccctggtgctaactgctgacagtggccacctcttttttggggattgaggggcctacataactagctggccttaccccatatcttttgttcaaacataataccatctttttgcttcttctgaactttagatctccataacacatgtactgtagaatgtgatggaaaagcattgatgagaatttattggcagttcagattgtgttttcccaacttaggctctttattaattggttaaggttttctccaaaaagggcatttcaacaatgggaattatttaatgtaacagtgggcacagattacttatcttccttctctgctttgtgactcaccagcagtaacacacacaatccacatcttgtgcacctcaaatgaacagacttggtttccttgctttcttgacatttccatgactgtttcacatacaaactattgggtgaggtttttcagctgttaccgacccacgtcctgctgtctctgtgtggtcctacaaaaactgtccattcccacccctttgctttgccatttgcaagagtctggaattgtcaggtctcagcttcgaaaagtcctggttccactgacaggacacattctttagtgggaattaagacctacaaagtctagtttgtatgtaggtatgaagggaattttttaaataaattgaaaagctgtgaacagcattagaactttgtctatttcttaattttaaaatatgctgatatgccttaaactgtagttgtagatccttgtcattttgctgtttgaaaataaccaatgtgttttctaaaactgtcgtgtaatctactttcattgttaatgcagaattgtcatatatgtaagctgcatgttagacatttgtcttttttaaactaaagtaattgtattgatgtgaagcatatcattttttcaaatatgaaagtgatcacttagcaacatgcttggtaatttggcatctgttaaggtaggagagtggtgaacagataatctatgcatatatcactagtgccaagacataaagcgggggaaaatatatttttacccaaacattaaaaaaaaaaaaaaaaaaaaaaaaaaaa

SEQ ID NO: 386 - protein, 429 aa, Homo sapiens
MAVAVGRPSNEELRNLSLSGHVGFDSLPDQLVNKSTSQGFCFNILCVGETGIGKSTLMDTLFNTKFESDPATHNEPGVRLKARSYELQESNVRLKLTIVDTVGFGDQINKDDSYKPIVEYIDAQFEAYLQEELKIKRSLFNYHDTRIHACLYFIAPTGHSLKSLDLVTMKKLDSKVNIIPIIAKADTIAKNELHKFKSKIMSELVSNGVQIYQFPTDEETVAEINATMSVHLPFAVVGSTEEVKIGNKMAKARQYPWGVVQVENENHCDFVKLREMLIRVNMEDLREQTHTRHYELYRRCKLEEMGFKDTDPDSKPFSLQETYEAKRNEFLGELQKKEEEMRQMFVMRVKEKEAELKEAEKELHEKFDLLKRTHQEEKKKVEDKKKELEEEVNNFQKKKAAAQLLQSQAQQSGAQQTKKDKDKKNASFT

SEQ ID NO: 387 - DNA, 4377 bp, Homo sapiens
gagatggaagccagcctccgctaggcccggaagcctcgtctgagggggcgggggacggaggagggagcgggagtcgagcgagagcctgtggaggagtccgcctgctgtagcgtgcgtaagcaaggcagctacgccgggcggctacgctgcggaatcggcgtaggcgcctttggagaatcggcgggctgcgctccgctggggctggtcgcggagggggggaggggatgtcggtcagtgcgagatccgctgctgctgaggagaggagcgtcaacagcagcaccatggctcaacagaagaaccttgaaggctatgtgggatttgccaatctcccaaatcaagtatacagaaaatcggtgaagagaggttttgaattcacgcttatggtagtgggtgaatctggattgggaaagtcgacattaatcaactcattattcctcacagatttgtattctccagagtatccaggtccttctcatagaattaaaaagactgtacaggtggaacaatccaaagttttaatcaaagaaggtggtgttcagttgctgctcacaatagttgataccccaggatttggagatgcagtggataatagtaattgctggcagcctgttatcgactacattgatagtaaatttgaggactacctaaatgcagaatcacgagtgaacagacgtcagatgcctgataacagggtgcagtgttgtttatacttcattgctccttcaggacatggacttaaaccattggatattgagtttatgaagcgtttgcatgaaaaagtgaatatcatcccacttattgccaaagcagacacactcacaccagaggaatgccaacagtttaaaaaacagataatgaaagaaatccaagaacataaaattaaaatatacgaatttccagaaacagatgatgaagaagaaaataaacttgttaaaaagataaaggaccgtttacctcttgctgtggtaggtagtaatactatcattgaagttaatggcaaaagggtcagaggaaggcagtatccttggggtgttgctgaagttgaaaatggtgaacattgtgattttacaatcctaagaaatatgttgataagaacacacatgcaggacttgaaagatgttactaataatgtccactatgagaactacagaagcagaaaacttgcagctgtgacttataatggagttgataacaacaagaataaagggcagctgactaagagccctctggcacaaatggaagaagaaagaagggagcatgtagctaaaatgaagaagatggagatggagatggagcaggtgtttgagatgaaggtcaaagaaaaagttcaaaaactgaaggactctgaagctgagctccagcggcgccatgagcaaatgaaaaagaatttggaagcacagcacaaagaattggaggaaaaacgtcgtcagttcgaggatgagaaagcaaactgggaagctcaacaacgtattttagaacaacagaactcttcaagaaccttggaaaagaacaagaagaaagggaagatcttttaaactctctattgaccaccagttaacgtattagttgccaatatgccagcttggacatcagtgtttgttggatccgtttgaccaatttgcaccagttttatccataatgatggatttaacagcatgacaaaaattatttttttttttgttcttgatggagattaagatgccttgaattgtctagggtgttctgtacttagaaagtaagagctctaagtacctttcctacattttctttttttattaaacagatatcttcagtttaatgcaagagaacattttactgttgtacaatcatgttctggtggtttgattgtttacaggatattccaaaataaaaggactctggaagattttcattgaggataaattgccataatatgatgcaaactgtgcttctctatgataattacaatacaaaggttccattcagtgcagcatatacaataatgtaatttagtctaacacagttgaccctattttttgacacttccattgtttaaaaatacacatggaaaaaaaaaaaaccctatatgcttactgtgcacctagagcttttttataacaacgtctttttgtttgtttgttttggattctttaaatatatattattctcatttagtgccctctttagccagaatctcattactgcttcatttttgtaataacatttaatttagatattttccatatattggcactgctaaaatagaatatagcatctttcatatggtaggaaccaacaaggaaactttcctttaactccctttttacactttatggtaagtagcagggggggaaatgcatttatagatcatttctaggcaaaattgtgaagctaatgaccaacctgtttctacctatatgcagtctctttattttactagaaatgggaatcatggcctcttgaagagaaaaaagtcaccattctgcatttagctgtattcatatattgcatttctgtattttttgtttgtattgtaaaaaattcacataataaacgatgttgtgatgtaatattgtgtgaggtcttaaatatcctacagtcgatgtacaagagtagagtatgtttgggaagaaacttttcagcttaagtttgcctcctctacaatgacatcttttatatgcttgtctcatttagaatgcatatgtgctgattttctaatttaagagataccatatctctctattcatttctatctctcatttgtatgcttatttttctgagaacattttttttttcccccagacagggtcttgcttcattgcccaggctggagtgcggtggcacaaacacgacttgactgcagcctcaaccctctgggctcaagcagtcctcctgcctcagccccctgagtatctgggattgcaggcgtgcaccaccacgcctggctaatttttgtattttttgcagcctcccaaagttctgggattacaggcatgagccgtcatgcctggcctctgagaacagtttctgactcattcagattaggtatactctcaagtccctggaaactgaaattttttttaactgtaaagagggtagtgtcatttcttttcttaaggtcaagtgacatagattttaatgtaatgcataatttaggtaagaaattaattaatgtagcctagtttattatcttgaaatgttttaccctatttactttttaaaattaatgacctaagcggagggaataattataagtcaatagcagagagattgttgtttgggtgtttatttttttcagtttttgttttgagagattgggttaacacctctagccaaaattgtttggttttagggaggctaacaataacctactgaatttggaaaatgcaaaggtaaaaaatgtatatagactgcctgctgaactggttaagtactactgcttctgggaaatactatttcaaaattctatgtattataataataaatttgtaagacattcattattctaccatcctaatgaaaactttcagaagtctttctttatccatggcatgcccagggttttacctgaatctgatacaggatctatataactttactaggacttttgattgttgactccaggcttaggtatatcagaaggttctttttgccatttggcctgtggatgtctgagaagatcattcacaatacatgtaaaattcaggtaggcctaaggaaaggccagcctgtagaaagcaaaatggcagtgtctgttctccactgttggaggcattatgtaatttaagtatcctgttagccactgtctttctgctaattaagtggggctgaacaagtaagcactaataataccagtgaaccacttgggcaccttgtgggtagagttttgctgccacctagtggaatgggatatcattgcttccatatcaggttcacaagcaagttaagtgggcacagtttatttctgtgtagctcaggctgtaatcttgaaagctgaggagatacccatgcctctcagactcattagctgggtgtcacattaccacctgcacattctgacccaccgcatcttaatatgttttgtcctcttggagaaactaggagtagaagtcaggatatggtaggtaagggggaaaaaggaaagacggcttgatagctatgaatgcatgaggagcgaaatgttgactcagttatctagatcatggtctccaaacctgatgctatttccttacaaaaatatttgttgagcatgtgtccataattatatgtattgaacaatgaaaatatgtgtcaacaaatgtactgctacactaatgtgaacattatggaacaaaatttgaaagagtgaaataaaaggtttacactttcaaaaaaaaaaaaaaaaaaaaaaaaaaaaaa

SEQ ID NO: 388 - protein, 436 aa, Homo sapiens
MSVSARSAAAEERSVNSSTMAQQKNLEGYVGFANLPNQVYRKSVKRGFEFTLMVVGESGLGKSTLINSLFLTDLYSPEYPGPSHRIKKTVQVEQSKVLIKEGGVQLLLTIVDTPGFGDAVDNSNCWQPVIDYIDSKFEDYLNAESRVNRRQMPDNRVQCCLYFIAPSGHGLKPLDIEFMKRLHEKVNIIPLIAKADTLTPEECQQFKKQIMKEIQEHKIKIYEFPETDDEEENKLVKKIKDRLPLAVVGSNTIIEVNGKRVRGRQYPWGVAEVENGEHCDFTILRNMLIRTHMQDLKDVTNNVHYENYRSRKLAAVTYNGVDNNKNKGQLTKSPLAQMEEERREHVAKMKKMEMEMEQVFEMKVKEKVQKLKDSEAELQRRHEQMKKNLEAQHKELEEKRRQFEDEKANWEAQQRILEQQNSSRTLEKNKKKGKIF

SEQ ID NO: 389 - DNA, 2090 bp, Homo sapiens
ttttagtctccgcgtgaaaaggtccttcatgctaatctaattcaattcagttctcctttttctttcttcttctcctcgccctcttctcagggaaggaatcgtcaaaaatcaatgtttcaacagatctcgcggtgctattcgagattccctattaaaaaaaaatagaattgatgcaaacagcctgttccttccggggttttgggctggaactgcagcgcttagagagctcggtggaagctgctaaaggcggaggcggggctctggcgagttctccttccaccttcccccacccttctctgccaaccgctgtttcagcccctagctggattccagccattgctgcagctgctccacagcccttttcaggacccaaacaaccgcagccgctgttcccaggatggtgatccgtgtatatattgcatcttcctctggctctacagcgattaagaagaaacaacaagatgtgcttggtttcctagaagccaacaaaataggatttgaagaaaaagatattgcagccaatgaagagaatcggaagtggatgagagaaaatgtacctgaaaatagtcgaccagccacaggttaccccctgccacctcagattttcaatgaaagccagtatcgcggggactatgatgccttctttgaagccagagaaaataatgcagtgtatgccttcttaggcttgacagccccacctggttcaaaggaagcagaagtgcaagcaaagcagcaagcatgaaccttaagcactgtgctttaagcatcctgaaaaatgagtctccattgcttttataaaatagcagaattagctttgcttcaaaagaaataggcttaatgttgaaataatagattagttgggttttcacatgcaaacattcaaaatgaatacaaaattaaaatttgaacattatggtgattatggtgaggagaatgggatattaacataaaattatattaataagtagatatcgtagaaatagtgttgttacctgccaagccatcctgtatacaccaatgattttacaaagaaaacacccttccctccttctgccattactatggcaacttaagtgtatctgcagctctacattaaaaaggagaaagagaaataacctgtctctcattcctaagttgcctcattaattttcatgaacaagaatatgtacctttttgatgctatattactgcgattaaaaagttcttgcaggtaatgtttatgatatgttaaacgttgtaatttcctatcgtaattataacattcccattcttttgtagatgaaacttctacatattgaaccacagattttctgagcttctaaatgtagcctttcattgcacatttcagtgatcagaatagatatccttttacacgcacaaaagcaatagattcattcagtggacaagttccttgtttaactacacagctatgatggaatgatatatccaagttccttgcctcagtgaaatatgcatatgtatatcatgaaagtgggatgccaagtaagcttaaaatggcattctctagcaaagagattagacttttaaataactcttataaaacaggttggcgatcatttcccaagattggtttcccttgagtttttgctaaaacaaatcttagtagttttgcccgtttaaaacaactcacaatcgtaaatgctactattcctaagatatcttacctttttatttcagtttagccatgtattgtatgagtgtattagtctaagcagtgagaatcttttctatgcctctattccagcaaaaagtagaagtatcaaataaaaagggcaacttttaaaatattaagcctgaagacttctaaaaagacaagaaacatggcctaaataaccaacatagatttacatagtaagtttcacactaccttattaccaaaagcaaacacctcttactttaaactacattatcatgtatatctattgtatgctggtctttactttttgccaaaatcaacatataatgaagagatgcctttgtttcatgagattcaaacttgatgctatgctttaaaataaactcagtacttttagaaacataaaaaaaaaaaaaaaaaaaaaaaaaaaaaa

SEQ ID NO: 390 - protein, 114 aa, Homo sapiens
MVIRVYIASSSGSTAIKKKQQDVLGFLEANKIGFEEKDIAANEENRKWMRENVPENSRPATGYPLPPQIFNESQYRGDYDAFFEARENNAVYAFLGLTAPPGSKEAEVQAKQQA

SEQ ID NO: 391 - DNA, 1153 bp, Homo sapiens
aactccagggctagtgagctggaccggaagtaggtttctacccgaccgcattttacgtggtgctgcatttccggtagcggcggcgggaaatcggctgtgggagagaggctaggcctctgaggaggcgaatccggcgggtatcagagccatcagaaccgccaccatgacggtgggcaagagcagcaagatgctgcagcatattgattacaggatgaggtgcatcctgcaggacggccggatcttcattggcaccttcaaggcttttgacaagcacatgaatttgatcctctgtgactgtgatgagttcagaaagatcaagccaaagaactccaaacaagcagaaagggaagagaagcgagtcctcggtctggtgctgctgcgaggggagaatctggtctcaatgacagtagagggacctcctcccaaagatactggtattgctcgagttccacttgctggagctgccgggggcccagggatcggcagggctgctggcagaggaatcccagctggggttcccatgccccaggctcctgcaggacttgctgggccagtccgtggggttggcgggccatcccaacaggtgatgaccccacaaggaagaggtactgttgcagccgctgcagctgctgccacagccagtattgccggggctccaacccagtacccacctggccgtgggggtcctcccccacctatgggccgaggagcaccccctccaggcatgatgggcccacctcctggtatgagacctcctatgggtcccccaatggggatcccccctggaagagggactccaatgggcatgccccctccgggaatgcggcctcctccccctgggatgcgaggccttctttgacccttggccacagagtatggaagtagctccgcagaggcgtgggctcgattcctcagggccacgttaccacagacctgtttgtttcttatgctgttgttcgtggagtctcatgggattgtctggtttcccttacagggccccctcccccgggaatgcgcccaccaaggccctagactcatcttggccctcctcagctccctgcctgtttcccgtaaggctgtacatagtccttttatctccttgtggcctatgaaactggtttataataaactcttaagagaacattataattgc

SEQ ID NO: 392 - protein, 231 aa, Homo sapiens
MTVGKSSKMLQHIDYRMRCILQDGRIFIGTFKAFDKHMNLILCDCDEFRKIKPKNSKQAEREEKRVLGLVLLRGENLVSMTVEGPPPKDTGIARVPLAGAAGGPGIGRAAGRGIPAGVPMPQAPAGLAGPVRGVGGPSQQVMTPQGRGTVAAAAAAATASIAGAPTQYPPGRGGPPPPMGRGAPPPGMMGPPPGMRPPMGPPMGIPPGRGTPMGMPPPGMRPPPPGMRGLL

SEQ ID NO: 393 - DNA, 981 bp, Homo sapiens
gtttggggccagagtgggcgaggcgcggaggtctggcctataaagtagtcgcggagacggggtgctggtttgcgtcgtagtctcctgcagcgtctggggtttccgttgcagtcctcggaaccaggacctcggcgtggcctagcgagttatggcgacgaaggccgtgtgcgtgctgaagggcgacggcccagtgcagggcatcatcaatttcgagcagaaggaaagtaatggaccagtgaaggtgtggggaagcattaaaggactgactgaaggcctgcatggattccatgttcatgagtttggagataatacagcaggctgtaccagtgcaggtcctcactttaatcctctatccagaaaacacggtgggccaaaggatgaagagaggcatgttggagacttgggcaatgtgactgctgacaaagatggtgtggccgatgtgtctattgaagattctgtgatctcactctcaggagaccattgcatcattggccgcacactggtggtccatgaaaaagcagatgacttgggcaaaggtggaaatgaagaaagtacaaagacaggaaacgctggaagtcgtttggcttgtggtgtaattgggatcgcccaataaacattcccttggatgtagtctgaggccccttaactcatctgttatcctgctagctgtagaaatgtatcctgataaacattaaacactgtaatcttaaaagtgtaattgtgtgactttttcagagttgctttaaagtacctgtagtgagaaactgatttatgatcacttggaagatttgtatagttttataaaactcagttaaaatgtctgtttcaatgacctgtattttgccagacttaaatcacagatgggtattaaacttgtcagaatttctttgtcattcaagcctgtgaataaaaaccctgtatggcacttattatgaggctattaaaagaatccaaattcaaactaaaaaaaaaaaaaaaaaa

SEQ ID NO: 394 - protein, 154 aa, Homo sapiens [sequence omitted]

SEQ ID NO: 395 - DNA, 2197 bp, Homo sapiens
aaattaacgtactatcctccttacttttgggtcgggccctccgggaagatggcggccgtgcaggcggccgaggtgaaagtggatggcagcgagccgaaactgagcaagaagtggtggtaatcattagttccagggtgctctgccatgttgacgcaagctgctgtaaggcttgttagggggtccctgcgcaaaacctcctgggcagagtggggtcacagggaactgcgactgggtcaacttgctcctttcacagcgcctcacaaggacaagtcattttctgatcaaagaagtgagctgaagagacgcctgaaagctgagaagaaagtagcagagaaggaggccaaacagaaagagctcagtgagaaacagctaagccaagccactgctgctgccaccaaccacaccactgataatggtgtgggtcctgaggaagagagcgtggacccaaatcaatactacaaaatccgcagtcaagcaattcatcagctgaaggtcaatggggaagacccatacccacacaagttccatgtagacatctcactcactgacttcatccaaaaatatagtcacctgcagcctggggatcacctgactgacatcaccttaaaggtggcaggtaggatccatgccaaaagagcttctgggggaaagctcatcttctatgatcttcgaggagagggggtgaagttgcaagtcatggccaattccagaaattataaatcagaagaagaatttattcatattaataacaaactgcgtcggggagacataattggagttcaggggaatcctggtaaaaccaagaagggtgagctgagcatcattccgtatgagatcacactgctgtctccctgtttgcatatgttacctcatcttcactttggcctcaaagacaaggaaacaaggtatcgccagagatacttggacttgatcctgaatgactttgtgaggcagaaatttatcatccgctctaagatcatcacatatataagaagtttcttagatgagctgggattcctagagattgaaactcccatgatgaacatcatcccagggggagccgtggccaagcctttcatcacttatcacaacgagctggacatgaacttatatatgagaattgctccagaactctatcataagatgcttgtggttggtggcatcgaccgggtttatgaaattggacgccagttccggaatgaggggattgatttgacgcacaatcctgagttcaccacctgtgagttctacatggcctatgcagactatcacgatctcatggaaatcacggagaagatggtttcagggatggtgaagcatattacaggcagttacaaggtcacctaccacccagatggcccagagggccaagcctacgatgttgacttcaccccacccttccggcgaatcaacatggtagaagagcttgagaaagccctggggatgaagctgccagaaacgaacctctttgaaactgaagaaactcgcaaaattcttgatgatatctgtgtggcaaaagctgttgaatgccctccacctcggaccacagccaggctccttgacaagcttgttggggagttcctggaagtgacttgcatcaatcctacattcatctgtgatcacccacagataatgagccctttggctaaatggcaccgctctaaagagggtctgactgagcgctttgagctgtttgtcatgaagaaagagatatgcaatgcgtatactgagctgaatgatcccatgcggcagcggcagctttttgaagaacaggccaaggccaaggctgcaggtgatgatgaggccatgttcatagatgaaaacttctgtactgccctggaatatgggctgccccccacagctggctggggcatgggcattgatcgagtcgccatgtttctcacggactccaacaacatcaaggaagtacttctgtttcctgccatgaaacccgaagacaagaaggagaatgtagcaaccactgatacactggaaagcacaacagttggcacttctgtctagaaaataataattgcaagttgtataactcaggcgtctttgcatttctgcgaaagatcaaggtctgcaagggaattcttgtgtgctgctttccatttgacaccgcagttctgttcagccatcagaagagagacaaggaattaaaaatttctttttaatcctgttaccaaataaaaaa

SEQ ID NO: 396 - protein, 625 aa, Homo sapiens
MLTQAAVRLVRGSLRKTSWAEWGHRELRLGQLAPFTAPHKDKSFSDQRSELKRRLKAEKKVAEKEAKQKELSEKQLSQATAAATNHTTDNGVGPEEESVDPNQYYKIRSQAIHQLKVNGEDPYPHKFHVDISLTDFIQKYSHLQPGDHLTDITLKVAGRIHAKRASGGKLIFYDLRGEGVKLQVMANSRNYKSEEEFIHINNKLRRGDIIGVQGNPGKTKKGELSIIPYEITLLSPCLHMLPHLHFGLKDKETRYRQRYLDLILNDFVRQKFIIRSKIITYIRSFLDELGFLEIETPMMNIIPGGAVAKPFITYHNELDMNLYMRIAPELYHKMLVVGGIDRVYEIGRQFRNEGIDLTHNPEFTTCEFYMAYADYHDLMEITEKMVSGMVKHITGSYKVTYHPDGPEGQAYDVDFTPPFRRINMVEELEKALGMKLPETNLFETEETRKILDDICVAKAVECPPPRTTARLLDKLVGEFLEVTCINPTFICDHPQIMSPLAKWHRSKEGLTERFELFVMKKEICNAYTELNDPMRQRQLFEEQAKAKAAGDDEAMFIDENFCTALEYGLPPTAGWGMGIDRVAMFLTDSNNIKEVLLFPAMKPEDKKENVATTDTLESTTVGTSV

SEQ ID NO: 397 - DNA, 5905 bp, Homo sapiens; identical to SEQ ID NO: 187

SEQ ID NO: 398 - protein, 963 aa, Homo sapiens; identical to SEQ ID NO: 188

SEQ ID NO: 399 - DNA, 4478 bp, Homo sapiens
gccccgcgcctgaggggcagtaaaagtcgccaggtccggctccatttctggcacaaaacttgcagcaccgaggggttgtggagagcccttgcaggggaagagggcagggtcatcccgagaaccaacgggcacgtatagcccggcgaacgcccaagccggtcaccgcccccggtcacgtgtcgccagcctccgcggccgcgcgccgctctcagcaccgttcccgccccacccggcccggcagtcggcccgcgcctcccccggcgctactgccacctcgcgctcggaggcgtcacagaacgtgctcttctctcccctcccccctcccgctctccccctcctccccctcccgctccaagattcgccgccgccgccgccgcagccgcaggagtagccgccgccggagccgcgcgcagccatggccgagaaccccagcttggagaaccaccgcatcaagagcttcaagaacaagggccgcgatgtggaaacaatgcgaagacatagaaatgaagtgacagtggaactgcggaagaacaaaagagatgaacacttattgaaaaagagaaatgttccccaagaagaaagtctagaagattcagatgttgatgctgattttaaagcacaaaatgtaaccctagaagctatattgcagaatgccacaagtgataacccagtggtccaattgagtgctgtccaggcagcaagaaaactgttatccagtgacagaaatccaccgattgatgacttaataaaatctgggattttaccaattctagtcaaatgtctagaaagggatgataatccttcattacagtttgaagctgcttgggcattaactaacatagcatcaggaacttctgcacagactcaagctgttgtgcagtctaatgcagtacctctttttctgagacttcttcgttcaccacatcagaatgtttgtgaacaagcagtatgggctttgggaaacattataggtgatggtcctcaatgtagagattatgtcatatcactgggagttgtcaaacctcttctgtccttcatcagtccctccatccccatcaccttccttcggaacgtcacatgggtcattgtcaatctctgcaggaataaggatcccccgccgcctatggagacagttcaggagattttgccagctttatgtgtcctcatataccatacagatataaacattcttgtagacactgtttgggctctgtcatacttgacagatggaggtaatgaacagatacagatggttattgattcaggagttgtgccctttcttgtgccccttctgagccatcaggaagtcaaagttcaaacagcagccctcagagcagttggcaacatagtgactggcaccgacgagcagacccaggttgttctcaattgtgatgtcctgtcacacttcccaaatctcttatcacacccaaaagagaagataaataaggaagcagtgtggttcctttccaacataacagcaggcaaccagcaacaagttcaagctgtaatagatgctggattaattcctatgataattcatcagcttgctaagggggactttggaacacaaaaagaagctgcttgggcaatcagcaacttaacaataagtggcagaaaagatcaggttgagtaccttgtacagcagaatgtaataccaccgttctgtaatttactgtcagtgaaagattctcaagtggttcaggtggttctagatggtctaaaaaacattctgataatggccggtgatgaagcaagcacaatagctgaaataatagaggaatgtggaggtttggagaaaattgaagttttacagcaacatgaaaatgaagacatatataaattagcatttgaaatcatagatcagtatttctctggtgatgatattgatgaagatccctgcctcattcctgaagcaacacaaggaggtacctacaattttgatccaacagccaaccttcaaacaaaagaatttaatttttaaattcagttgagtgcagcatctttcccacattcaatatgaagcaccaccagatggctaccaaatgataagaacaacagcaacaaaaggctccaaaacacacatgcctctttgttttgatgcttctaaagcaagccatgtctcagtcactttgcagttgccaaaagtcactatcacatggactgtaaatgcatatgcatgatttcctaaactgttttagaactctccttaacaatctcaactaccctatttttccctgttccctggtgccacaggctgacaactgcagtctccagtttagaataaatattccatagtggtgacatgtcagctgcccactgatactcctttggaaaatggtgcgctgtggatcaagacactttggtatgatgcatatacaagttggaagactaaagaggtgcagtgtgatctgagcctccatcattgtcctccacaaacatattttcatattctttatgtggaagaatagattttaaagtacaagccaaatgattttcattggtggaactgacacaaaaaaagtaacttaaaaacaagaaacttggttattgaataaacagataagtttaaaaaaaaaaaaaaactacttcatctaccagtaattgatgtgtttattatctgcctcagaagccagggttggaggaagaactttagatatggatattaatgcttttgccattatacctaatttttgagaacagcaagccctatttgaccactctcttcagcctgtgtgttcctgctgttttgaagtaatcaaatgctgtgcatggtattttacctgagctgcaacctgttatggacttgaacttctgtttaagttgaaagcaagagtccctgagtataaaggaaaaacagcaaaacaaaaagcaaacaaaaaaaaactgcaaaagtctaaaatacccattggtgatgttttttaaaaaaatcttgctttcagctttcaggagttaatattctttgttttaatttgataattggatatggttgatttatattgggtttaaactgtggagctttcatgtttactgtaatttagtcttaaaatattttttacttagtaaccagtgcttttgataatgtggttggcaacaaaccagcaactatttagaagtgtcataagagttcattctttgagtattgggaaagttaattcagatcctactcaaaaagcatcttcacatattaaaagattcagacagggatctgtgtagaggagtaatttgcagttatttaacataaacctgatttgcagtgatctctaagtaattctgcaaaatccggtattactatgtcaagttattgcttttggtaaattgtctgacccagttattaatgaaagaatatggatttaaaaatttttaaactaaataatttgtgctgtcacagaaatggtattgttgctcttgtttactgggtataatttcccaatgcattgatgtgaagggatagaaaatctaaactaatttagttatccattggggggtgtatttactgtgatgaagatgagacagatgccatcagagctttgtgaatcagctggggtgttttcactgataaacaacacatagcaggtgtgcattcattacaaatatatgtatctgccaaggtggagccactttaaagagtgagttttgtcttgtatctaaagtggatacaagcgtatgtttaaactgcaagatttttacttgctagagaatctgttttaatatagtggtttggcctctgattatttataggttttataaattttagaatcaatttctctttaaggtggctcagatttttcaactcttgtgcacataaaattgagttgaagttcattgtgcctttttttctttatccaaattttgagttaaagcttcatatggtaactgcatcctgttcggacactatagtctaaatttttgaaactgtgtggtgttcgctaaaagtaggaataacaacgtaaaagctaattaaggtcacaaacttcggtgaaacccttaaaagtccaaatcttcttgatattgtgaaccgtaccccttccagtttagtttcttctggactttccttacttaactgacagttaccttttaaaatttgcacacattatgattaaaattgggcctctactgtgatgattcctatttcctctcatgttttaaagtgcaaactaacatttaagtgaacattagcatcaagtagtgcagacacttgtatgcatttccttgattcaatttgtgaccttaccagttttgaattggaattgcaccatttcgtagataaaggaaactaagtatattgctgcacttttaagttttcaaaacagtgtttaaaaattgcattgttatttttttttaaactcagtttaaaaagactaaaacgttctttcaaaagaggcatctaaatgtgttcctaattttgtatatgggcttaggttttgtaaccaataaaaaaagctgctatcaaatatgataaaacattgaaaacttaaaaa

SEQ ID NO: 400 - protein, 521 aa, Homo sapiens
MAENPSLENHRIKSFKNKGRDVETMRRHRNEVTVELRKNKRDEHLLKKRNVPQEESLEDSDVDADFKAQNVTLEAILQNATSDNPVVQLSAVQAARKLLSSDRNPPIDDLIKSGILPILVKCLERDDNPSLQFEAAWALTNIASGTSAQTQAVVQSNAVPLFLRLLRSPHQNVCEQAVWALGNIIGDGPQCRDYVISLGVVKPLLSFISPSIPITFLRNVTWVIVNLCRNKDPPPPMETVQEILPALCVLIYHTDINILVDTVWALSYLTDGGNEQIQMVIDSGVVPFLVPLLSHQEVKVQTAALRAVGNIVTGTDEQTQVVLNCDVLSHFPNLLSHPKEKINKEAVWFLSNITAGNQQQVQAVIDAGLIPMIIHQLAKGDFGTQKEAAWAISNLTISGRKDQVEYLVQQNVIPPFCNLLSVKDSQVVQVVLDGLKNILIMAGDEASTIAEIIEECGGLEKIEVLQQHENEDIYKLAFEIIDQYFSGDDIDEDPCLIPEATQGGTYNFDPTANLQTKEFNF

SEQ ID NO: 401 - DNA, 586 bp, Homo sapiens
agttaaaagggtgggagcgtccgggggcccatctctctcgggtggagtcttctgacagctggtgcgcctgcccgggaacatcctcctggactcaatcatggcttgtggtctggtcgccagcaacctgaatctcaaacctggagagtgccttcgagtgcgaggcgaggtggctcctgacgctaagagcttcgtgctgaacctgggcaaagacagcaacaacctgtgcctgcacttcaaccctcgcttcaacgcccacggcgacgccaacaccatcgtgtgcaacagcaaggacggcggggcctgggggaccgagcagcgggaggctgtctttcccttccagcctggaagtgttgcagaggtgtgcatcaccttcgaccaggccaacctgaccgtcaagctgccagatggatacgaattcaagttccccaaccgcctcaacctggaggccatcaactacatggcagctgacggtgacttcaagatcaaatgtgtggcctttgactgaaatcagccagcccatggcccccaataaaggcagctgcctctgctccctctgaaaaaaaaaaaaaaaaaaaaaaaaaaaaaa

SEQ ID NO: 402 - protein, 135 aa, Homo sapiens
MACGLVASNLNLKPGECLRVRGEVAPDAKSFVLNLGKDSNNLCLHFNPRFNAHGDANTIVCNSKDGGAWGTEQREAVFPFQPGSVAEVCITFDQANLTVKLPDGYEFKFPNRLNLEAINYMAADGDFKIKCVAFD

SEQ ID NO: 403 - DNA, 17928 bp, Homo sapiens
attgtgggagccgctcccctcggctccgccacgctcccctcgactgcgctccagcctggggcgcgcccggccgccgccgccttcgctgccgccacgggcccgtcttcttcctccttcggctcccaggatgaagaaactgagtctcagagaggtgaagtgacttgcccaagatcacagcaattatcacttctccctgggctcccaggccctcctgcagcagcccccgcctgggccatgtcttcctcagatgaagagacgctcagtgagcggtcatgtcggagtgagcggtcttgtcggagtgagcgatcttacaggagcgagcggtcggggagcctgtctccctgtcccccaggggacaccttgccctggaacctgccactgcatgagcagaaaaagcggaaaagccaggattcggtgctggaccctgcagagcgtgctgtggtcagagtcgctgatgaacgggaccgggttcagaagaaaacgttcaccaagtgggtcaacaagcacttaatgaaggtccgcaagcacatcaatgatctttatgaagatctgcgggatggccataacctgatctctctgttggaggtcctctcaggcatcaaactgccccgggagaagggcaggatgcgttttcataggctgcagaatgtgcagattgccctggacttcctaaagcagcgacaggtgaaactagtgaatattcgcaatgatgacatcacagatggcaaccccaagttgaccctgggtctgatctggaccattattttgcatttccagatctctgacatctacattagtggagaatcaggggatatgtcagccaaggagaaactactcctgtggacccagaaggtgacagctggttacacaggaatcaaatgcaccaacttttcctcctgctggagtgatgggaagatgttcaatgcactcattcaccgataccgacccgatctagtagacatggagagggtgcaaatccaaagtaaccgagagaatctggaacaggcttttgaagtggcagaaagactgggggtcactcgcctgctggatgcagaagatgtggatgtgccatctccagatgaaaagtctgtaatcacttatgtgtcttcgatttatgatgccttccctaaagttcctgagggtggagaagggatcagtgctacggaagtggactccaggtggcaagaataccaaagccgagtggactccctcattccctggatcaaacagcatacaatactgatgtcagataaaacttttccccaaaaccctgttgaactaaaggcactttataaccaatatatacacttcaaagaaacagaaattctggccaaggagagagaaaaaggaagaattgaggaattatataaattactagaggtgtggattgaatttggccgaattaaactgcctcaaggttatcaccctaatgatgtggaagaagagtggggaaagctcatcatagagatgctggaacgagagaaatcacttcggccggctgtggagaggctggaattgctgctacagattgcaaacaaaatccagaatggtgctttgaactgtgaagaaaaactgacactagctaagaatacactgcaggctgatgctgctcacctggaatcaggacaaccggtacaatgtgagtcagatgtcattatgtacattcaggagtgtgaaggtctcatcaggcagctgcaggtggatctccagatcctgcgggatgagaattactaccagctagaagagctggcttttagggtcatgcgtcttcaggatgagctggtcaccttgcgtctagagtgtacaaacctgtaccggaagggtcatttcacttcacttgaattggttccaccctctactttaaccaccactcatctgaaagcagaacccttaaccaaggcaacccattcttcttctacctcctggttccgaaagcctatgactcgggctgaacttgtggccatcagctcctctgaagatgaaggcaatctccgatttgtgtatgaactactgtcttgggtagaagagatgcagatgaaactggagcgagcagagtggggcaatgacctgcctagtgtggagttgcagctagaaacacagcagcacatccatacgagtgtagaagagctgggctcaagtgtcaaggaggccaggttgtatgagggaaagatgtcccagaatttccataccagctatgctgaaactcttggaaagctggagacacagtattgtaaattgaaggaaacttctagcttccggatgaggcaccttcagagcctgcataaatttgtttccagagctacagctgagttgatctggttgaatgagaaggaggaggaggaactagcatatgactggagtgacaacaattccaatatctcagccaagagaaattacttctctgagttgacaatggaactggaggagaaacaggatgtgtttcgttctctacaagatacagcagaactactttcacttgagaaccacccagccaagcagacagtggaggcttacagtgctgctgtccagtcccagttgcagtggatgaagcagctgtgcctgtgtgttgagcagcatgtgaaagagaatactgcttattttcagttcttcagtgatgcacgagagctggagtcattcttgaggaacctccaagattccattaaacgaaaatattcctgtgaccacaacaccagcttatcccgccttgaagacctgctccaggactccatggatgaaaaggagcagcttatacagtccaagagttccgttgccagtctcgttgggagatcaaaaaccatcgttcagctaaaaccacgcagtccagaccatgtgttaaagaacaccatttctgtcaaggctgtctgtgactacaggcagatcgagattactatttgcaaaaatgatgaatgtgtgctagaagataattctcagcggaccaaatggaaagtgatcagccccacagggaacgaggcaatggtgccgtcagtctgcttcctcatccccccacccaataaggatgccattgagatggccagcagggtcgaacaatcttatcagaaggttatggccctttggcatcagctgcatgttaacaccaaaagccttatctcttggaactatctgcgtaaagaccttgaccttgtacagacctggaacctagaaaagcttcgatcctcagcaccaggggagtgccatcagattatgaagaaccttcaggcccactatgaagactttctgcaggatagtcgtgactctgtgctgttctcagtggctgatcgcttgcgcttggaagaggaggtggaagcttgtaaagcccgcttccagcacctgatgaagtccatggagaatgaggacaaagaggagactgtggccaagatgtacatttcagagttgaagaacatccggctacgcctggaggagtatgaacagagggtggtcaaacgaattcagtctctagccagctctaggactgacagagatgcctggcaggacaatgcattaaggattgcagagcaagagcacacccaggaggatttacagcaattgaggtcagacttggatgcagtttctatgaaatgtgacagctttctccatcagtctccatctagttcaagtgtcccaactctgcgctcagaactgaatctgctggtggagaagatggaccatgtctatggtctctctactgtatatctgaataagttaaagacagttgatgttatagtacgtagcatacaggatgctgaactcttggtcaaaggttatgagattaagctgagtcaagaagaagtagtactggcagatctctcagctctggaggcccattggtcgacattacggcactggcttagtgatgtgaaggacaagaattcagtgttttcagtcctggatgaggaaattgccaaggccaaggtagtggcagagcagatgagtcgtctgacaccagagcgaaatctggatttggagcgctatcaggaaaaaggctcccagctgcaggagcgttggcaccgagtcattgcccagctcgagattcgccaatctgagctagaaagtatccaggaagttctgggagattaccgagcctgccatggaactctcatcaagtggattgaggaaaccactgcccagcaggaaatgatgaagccaggccaggcagaggatagcagagtgctttcggagcagctcagccagcagacggccctatttgcagaaattgagagaaatcagacaaaactggatcaatgtcaaaaattttcccagcagtactctactattgtaaaggactatgaattgcaactgatgacatacaaggcctttgtggaatcgcagcagaaatcccctggcaagcgccgtcgcatgctttcctcttcagatgccatcactcaagagttcatggacttaaggactcgctacacggcattggtgactttaacaactcagcacgtgaaatacatcagtgatgcactccggcgtctggaggaggaggagaaagtggtagaagaggagaaacaagaacatgtggagaaggttaaagaacttttgggctgggtgtctaccctagcgaggaatacacaaggaaaagctacctcatccgagaccaaagaatcaacagacattgaaaaagctattttggaacagcaggttctgtcagaagagctgacaacaaagaaagaacaagtctctgaagctattaaaacatcacagatcttcttggccaagcatggtcataagctctcagaaaaagagaagaaacaaatatctgagcaattgaatgccctaaacaaggcttaccatgacctttgtgatggttctgcaaatcagcttcagcagcttcagagccagttggctcaccagacagaacaaaagaccctgcagaaacaacaaaatacctgtcaccagcaactggaggatctttgcagttgggtaggacaggcagaaagagcactggcaggccaccaaggcagaaccacccagcaggatctctctgctttgcagaagaaccaaagtgacttgaaggatttacaggatgacattcagaatcgtgccacctcatttgccactgttgtcaaggacattgaggggttcatggaagagaatcagaccaagctgagcccacgtgagttgacagctcttcgggaaaagcttcatcaggctaaggagcaatatgaggcgctccaggaagagacacgtgtggcccagaaggaactggaggaagcagtgacctccgccttacagcaggagactgaaaagagtaaagcagcaaaggaactggcagagaacaagaagaagatcgatgctctcctggattgggtaacttcagtaggatcatctggtggacagctgctgaccaaccttccaggaatggagcagctctcgggagctagcttggagaaaggagccttggacaccactgatggttacatgggggtgaatcaagccccagagaaactggacaagcaatgtgagatgatgaaggcccgtcaccaagaattgctgtcccagcagcaaaatttcattctggccacccagtcagctcaggccttcttggatcagcatggccacaatctcacacctgaggagcaacagatgctgcaacagaagctgggagagctaaaggaacaatactctacttccctggcccaatcagaggcagaactgaagcaggtgcagacacttcaggatgagttgcagaaatttctgcaggatcataaagagtttgaaagctggttggaacgatccgagaaagagctggagaacatgcataagggaggcagcagccccgagacccttccctccctgctaaagcggcaaggaagcttctcagaggatgtcatttcccacaaaggagacttgagatttgtgactatctcaggacagaaagtcttggacatggaaaacagttttaaggaaggcaaagaaccatcagaaattggaaacttagtaaaggacaagttgaaggatgcaacagaaagatacactgctctccactcaaagtgtacacgattaggatctcacctgaatatgctgttaggccagtatcatcaattccaaaacagtgctgacagcctgcaggcctggatgcaggcttgtgaggccaacgtggagaagctcctctcagatactgttgcctctgaccctggagttctccaggagcagcttgcaacaacaaagcagttgcaggaggaattggctgagcaccaagtacctgtggaaaaactccaaaaagtagctcgtgacataatggaaattgaaggggagccagccccagaccacaggcatgttcaagaaactacagattccatactcagccacttccaaagcctctcctatagcctggctgagcgatcttctctgctgcagaaagcaattgcccaatctcagagtgtccaggaaagcctggagagcctgttgcagtctattggggaagttgaacaaaacctggaagggaagcaggtgtcatcactctcatcaggagtcatccaggaagccttagccacaaatatgaaattgaagcaggacattgctcggcaaaagagcagcttggaggccacccgtgagatggtgacccgattcatggagacagcagacagtactacagcagcagtgctgcagggcaaactggcagaggtgagccagcggttcgaacagctctgtctacagcagcaagaaaaggagagctccctaaagaagcttctaccccaggcagagatgtttgaacacctctctggtaagctgcagcagttcatggaaaacaaaagtcggatgctggcctctggaaatcagccagatcaagatattacacatttcttccaacagatccaggagctcaatttggaaatggaagaccaacaggagaacctagatactcttgagcacctggtcactgaactgagctcttgtggctttgcgctggacttgtgccagcatcaggacagggtacagaatctaagaaaagacttcacagagctacagaagacagttaaagagagagagaaagatgcatcatcttgccaggaacagttggatgaattccggaagctggtcaggaccttccagaaatggttgaaagaaactgaagggagtattccacctacggaaacttctatgagtgctaaagagttagaaaagcagattgaacacctgaagagtctactagatgactgggcaagtaagggaactctggtggaagaaatcaattgcaaaggtacttctttagaaaatctcatcatggaaatcacagcacctgattcccaaggcaagacaggttccatactgccctctgtaggaagctctgtaggcagtgtaaacggataccacacctgcaaagatctgacggagatccagtgtgacatgtcagatgtaaacttgaagtatgagaaactagggggagtacttcatgaacgccaggaaagccttcaggctatcctcaacagaatggaggaggttcacaaggaggcaaactctgtgctgcagtggctggaatcaaaagaggaagtcctgaaatccatggatgccatgtcatctccaaccaagacagaaacagtgaaagcccaagctgaatctaacaaggccttcctggctgagttggaacagaattctccaaaaattcaaaaagtaaaggaagccctggctggattactggtgacatatcccaactcacaggaagcagaaaattggaagaaaattcaggaagaactcaattcccgatgggaaagggccactgaggttactgtggctcggcaaaggcagctagaggaatctgcaagtcatctggcctgcttccaggctgcagaatcccagctccggccgtggctgatggagaaagaactgatgatgggagtgctggggcccctgtctattgaccccaacatgttgaatgcacaaaagcaacaggtccagtttatgctaaaggaatttgaagcacgcaggcaacagcatgagcaactgaatgaggcagctcagggcatcctaacaggccctggagatgtctctctgtccaccagccaagtacagaaagaactccagagcatcaatcagaaatgggttgagctgactgacaaactcaactcccgttccagccaaattgaccaagctattgttaagagcacccagtaccaggaactgctccaggacttatcagagaaggtgagggcagttggacaacggctgagtgtccagtcagctatcagcacccaaccagaggctgtaaagcagcaattggaagagaccagtgaaattcgatctgacttggagcagttagaccacgaggttaaggaggctcagacactgtgcgatgaactctcagtgctcattggtgagcagtacctcaaggatgaactgaagaagcgtttggagacagttgccctgcctctccaaggtttagaagaccttgcagccgatcgcattaacagactccaggcagctcttgccagcacccagcagttccagcaaatgtttgatgagttgaggacctggttggatgataaacaaagccagcaagcaaaaaactgcccaatttctgcaaaattggagcggctacagtctcagctacaggagaatgaagagtttcagaaaagtcttaatcaacacagtggctcctatgaggtgattgtggctgaaggggaatctctacttctttctgtacctcctggagaagagaaaaggactctacaaaaccagttggttgagctcaaaaaccattgggaagagcttagtaaaaaaactgcagacagacaatccaggctcaaggattgtatgcagaaagctcagaaatatcagtggcatgtggaagaccttgtgccatggatagaagattgtaaagctaagatgtctgagttgcgagtcactctggatccagtgcagctagagtccagtctcctaagatcaaaggctatgctgaatgaggtggagaagcgccgctccctgctggaaatattgaatagtgctgctgacattctgatcaattcttcagaagcagatgaggatggaatccgggatgagaaggctgggatcaaccagaacatggatgctgttacagaagagctgcaggccaaaacagggtcactcgaagaaatgactcagaggctcagggagttccaggaaagctttaagaatattgaaaagaaggttgaaggagccaaacaccaacttgagatctttgatgctctgggttctcaagcctgtagcaacaagaacctggagaagctaagagctcaacaggaagtgctgcaggccctagagcctcaggtagactatctgaggaactttactcagggtctggtagaagatgccccagatggatctgatgcttctcaacttctccaccaagctgaggtcgcccagcaagagttcctcgaagttaagcaaagagtgaacagtggttgtgtgatgatggaaaacaagctggaggggattggccagtttcactgccgggtccgagagatgttctctcaattggcagacctggatgatgagctagatggcatgggtgctattggcagagacactgatagcctccagtcccaaatcgaggatgtccggctattccttaacaaaattcacgtcctcaaattagacatagaggcctctgaagcagagtgtcgacatatgctagaagaagaggggactctggatttgttaggtctcaaaagggagctagaagccctgaacaaacagtgtggcaaactgacagagagggggaaagctcgtcaggaacagctggaactgacactaggccgtgtagaggacttctacaggaaattgaaaggactcaatgacgcgaccacagcagcagaggaggcagaggccctccagtgggtagtggggaccgaagtggaaatcatcaaccaacaattagcagattttaaaatgtttcagaaagaacaagtggatcctcttcagatgaaattgcagcaggtgaatggacttggccagggattaattcagagtgcaggaaaagactgtgatgtacagggtttagaacatgacatggaagagatcaatgctcgatggaatacattgaataaaaaggtcgcacaaagaattgcacagctacaggaagctttgttgcattgtgggaagtttcaagatgccttggagccattgctcagctggttggcagataccgaggagctcatagccaatcagaaacctccatctgctgagtataaagtggtgaaagcacagatccaagaacagaagttgctccagcggctcctagatgatcgaaaggccacagtagacatgcttcaagcagaaggaggcagaatagcccagtcagcagagctggctgatagagagaaaatcactggacagctggagagtcttgaaagtagatggactgaactactcagtaaggcagcagccaggcaaaaacagctggaagacatcctggttctggccaaacagttccatgagacagctgagcctatttctgacttcttatctgtcacagagaaaaagcttgctaactcagaacctgttggcactcagactgccaaaatacagcagcagatcattcggcacaaggctctggaagaagacatagaaaaccatgcaacagatgtgcaccaggcagtcaaaattgggcagtccctctcctccctgacatctcctgcagaacagggtgtgctgtcagaaaagatagactcattgcaggcccgatacagtgaaattcaagaccgctgttgtcggaaggcagccctacttgaccaagctctgtctaatgctaggctgtttggggaggatgaggtggaggtgctcaactggctggctgaggttgaggacaagctcagttcagtgttcgtaaaggatttcaaacaggatgtcctgcacaggcagcatgctgaccacctggctttaaatgaagaaattgttaatagaaagaagaatgtagatcaagctattaaaaatggtcaggctcttctaaaacaaaccacaggtgaggaggtgttacttatccaggaaaaactagatggtataaagactcgttacgcagacatcacagttactagctccaaggccctcagaactttagagcaagcccggcagctggccaccaagttccagtctacttatgaggaactgaccgggtggctgagggaggtggaggaggagctggcaaccagtggaggacagtctcccacaggggaacagataccccagtttcagcagagacagaaggaattaaagaaggaggtcatggagcacaggctggtgttggacacagtgaatgaggtgagccgtgctctcttagagctggtgccctggagagccagagaagggctggataaacttgtgtccgatgctaacgagcagtacaaactagtcagtgacactattggacaaagggtggatgaaattgatgctgctattcagagatcacaacagtatgagcaagctgccgatgcagaactagcttgggttgctgaaacaaaacggaaactgatggctctgggtccaattcgcctggaacaggaccagaccacagctcagcttcaggtacagaaggctttctccattgacattattcgacacaaagattcaatggatgaactcttcagtcaccgtagtgaaatctttggcacatgtggggaggagcaaaaaactgtattacaggaaaagacagagtctctaatacagcaatatgaagccattagcctactcaattcagagcgttatgcccgcctagagcgggcccaggtcttagtaaaccagttttgggaaacttatgaagagctcagcccctggattgaggaaactcgggcactaatagcacagttaccctctccagccattgatcatgagcagctcaggcagcaacaagaggaaatgaggcaattaagggaatctattgctgaacacaaacctcatattgacaaactactaaagataggcccacaactaaaggaattaaaccctgaggaaggggaaatggtggaagaaaaataccagaaagcagaaaacatgtatgcccaaataaaggaggaggtgcgccagcgagccctggctctggatgaagccgtgtcccagtccacacagattacagagtttcatgataaaattgagcctatgttggagacactggagaatctttcctctcgcctgcgtatgccaccactgatccctgctgaagtagacaagatcagagagtgcatcagtgacaataagagtgccaccgtggagctagaaaaactgcagccatcctttgaggccttgaagcgccgtggagaggagcttattggacgatctcagggagcagacaaggatctggctgcaaaagaaatccaggataaattggatcaaatggtattcttctgggaggacatcaaagctcgggctgaagaacgagaaatcaaatttcttgatgtccttgaattagcagagaagttctggtatgacatggcagctctcctgaccaccatcaaagacacccaggatattgtccatgacttggaaagcccaggcattgatccttccatcatcaaacaacaggttgaagctgctgagactattaaggaagagacagatggtctgcatgaagagctggagtttattcggatccttggagcagatttgatttttgcctgtggagaaactgagaagcctgaagtgaggaagagcattgatgagatgaataatgcttgggagaacttaaacaaaacatggaaagagaggctagaaaaacttgaggatgctatgcaagctgctgtgcagtatcaggacactcttcaggctatgtttgactggctagataacactgtgattaaactctgcaccatgccccctgttggcactgacctcaatactgttaaagatcagttaaatgaaatgaaggagttcaaagtagaagtttaccaacagcaaattgagatggagaagcttaatcaccagggtgaactgatgttaaagaaagctactgatgagacggacagagacattatacgagaaccactgacagaactcaaacacctctgggagaacctgggtgagaaaattgcccaccgacagcacaaactagaaggggctctgttggcccttggtcagttccagcatgccttagaggaactaatgagttggctgactcataccgaagagttgttagatgctcagagaccaataagtggagacccaaaagtcattgaagttgagctcgcaaagcaccatgtcctaaaaaatgatgttttggctcatcaagccacagtggaaacagtcaacaaagctggcaatgagcttcttgaatccagtgctggagatgatgccagcagcttaaggagccgtttggaagccatgaaccaatgctgggagtcagtgttacagaaaacagaggagagggagcagcagcttcagtcaactctgcagcaggcccagggcttccacagtgaaattgaagatttcctcttggaacttactagaatggagagccagctttctgcatctaagcccacaggaggacttcctgaaactgctagggaacagcttgatacacatatggaactctattcccagctgaaagccaaggaagagacttataatcaactacttgacaagggcagactcatgcttctaagccgtgacgactctgggtctggctccaagacagaacagagtgtagcacttttggagcagaagtggcatgtggtcagcagtaagatggaagaaagaaagtcaaagctggaagaggccctcaacttggcaacagaattccagaattccctacaagaatttatcaactggctcactctagcagagcagagtttaaacatcgcttctccaccaagcctgattctaaatactgtcctttcccagatagaagagcacaaggtttttgctaatgaagtaaatgctcatcgagaccagatcattgagctggatcaaactgggaatcaattaaagttccttagccaaaagcaggatgttgttctgatcaagaatttgttggtgagcgtgcagtctcgatgggagaaggttgtccagcgatctattgaaagagggcgatcactagatgatgccaggaagcgggcaaaacaattccatgaagcttggaaaaaactgattgactggctagaagatgcagagagtcacctggactcagaactagagatatccaatgacccagacaaaattaaacttcagctttctaagcataaggagtttcagaagactcttggtggcaagcagcctgtgtatgataccacaattagaactggcagagcactgaaagaaaagactttgcttcccgaagatagtcagaaacttgacaatttcctaggagaagtcagagacaaatgggatactgtttgtggcaagtctgtggagcggcagcacaagttggaggaagccctgctcttttcgggtcagttcatggatgctttgcaggcattggttgactggttatacaaggtggagccacagctggctgaggaccagcccgtgcacggggaccttgacctcgtcatgaacctcatggatgcacacaaggttttccagaaggaactgggaaagcgaacaggaaccgttcaggtcctgaagcggtcaggccgagagctgattgagaatagtcgagatgacaccacttgggtaaaaggacagctccaggaactgagcactcgctgggacactgtctgtaaactctctgtttccaaacaaagccggcttgagcaggccttaaaacaagcggaagtgtttcgagacacagtccacatgctgttggagtggctttctgaagcagagcaaacgcttcgctttcggggagcacttcctgatgacacagaggccctgcagtctctcattgacacccataaggaattcatgaagaaagtagaagaaaagcgagtggacgttaactcagcagtagccatgggagaagtcatcctggctgtctgccaccccgattgcatcacaaccatcaaacactggatcaccatcatccgagctcgcttcgaggaggtcctgacatgggctaagcagcaccagcagcgtcttgaaacggccttgtcagaactggtggctaatgctgagctcctggaagaacttctggcatggatccagtgggctgagaccaccctcattcagcgggatcaggagccaatcccgcagaacattgaccgagttaaagcccttatcgctgagcatcagacatttatggaggagatgactcgcaaacagcctgacgtggaccgggtcaccaagacatacaaaaggaaaaacatagagcctactcacgcgcctttcatagagaaatcccgcagcggaggcaggaaatccctaagtcagccaacccctcctcccatgccaatcctttcacagtctgaagcaaaaaacccacggatcaaccagctttctgcccgctggcagcaggtgtggctgttagcactggagcggcaaaggaaactgaatgatgccttggatcggctggaggagttgaaagaatttgccaactttgactttgatgtctggaggaaaaagtatatgcgttggatgaatcacaaaaagtctcgagtgatggatttcttccggcgcattgataaggaccaggatgggaagataacacgtcaggagtttatcgatggcattttagcatccaagttccccaccaccaagttagagatgactgctgtggctgacattttcgaccgagatggggatggttacattgattattatgaatttgtggctgctcttcatcccaacaaggatgcgtatcgaccaacaaccgatgcagataaaatcgaagatgaggttacaagacaagtggctcagtgcaaatgtgcaaaaaggtttcaggtggagcagatcggagagaataaataccggtttggggattctcagcagttgcggctggtccgtattctgcgcagcaccgtgatggttcgcgttggtggaggatggatggccttggatgaatttttagtgaaaaatgatccctgccgagcacgaggtagaactaacattgaacttagagagaaattcatcctaccagagggagcatcccagggaatgacccccttccgctcacggggtcgaaggtccaaaccatcttcccgggcagcttcccctactcgttccagctccagtgctagtcagagtaaccacagctgtacatccatgccatcttctccagccaccccagccagtggaaccaaggttatcccatcatcaggtagcaagttgaaacgaccaacaccaacttttcattctagtcggacatcccttgctggtgataccagcaatagttcttccccggcctccacaggtgccaaaactaatcgggcagaccctaaaaagtctgccagtcgccctgggagtcgggctgggagtcgagccgggagtcgagccagcagccggcgaggaagtgacgcttctgactttgacctcttagagacgcagtctgcttgttccgacacttcagaaagcagcgctgcagggggccaaggcaactccaggagagggctaaacaaaccttccaaaatcccaaccatgtctaagaagaccaccactgcctcccccaggactccaggtcccaagcgataacactgtctaagcacccccaagccactatccactttgaatcctgctccatacattgggtgtatatttattctgaacgggagaagttatattgttaaaagtgtaaaagaataattgtgttatgaagctgccttattttttttctttttgtaagttactattttcatgtgaatatttatgtagataaaatttgcctcctggtaaccctgtaatggatggggcccagaaatgaaatatttgagaaaaacaagtgaaaaggtcaagatacaaatgtgtattaaaaaaaaaaaagcctattaatagggtttctgcgcggtgcagggttgtaaacctgctttatcttttaggattattcctaaatgcatcttctttataaacttgacttgctatctcagcaagataaattatattaaaaaaataagaatcctgcagtgtttaaggaactctttttttgtaaatcacggacacctcaattagcaagaactgaggggagggctttttccattgtttaatgttttgtgatttttagctaaagagagggaacctcatctaagtaacatttgcacatgatacagcaaaaggagttcattgcaatactgtctttggatattgtttcagtactgggtgtttaaaggacaaatagctgctagaattcaggggtaaatgtaagtgttcagaaaacgtcagaacatttggggttttaaactgatttgttgctccctatccagcctagacaccagtaactcttgtgttcaccaggacccagacccttggcaagggataggctcgttggtgacattgtgaatttcagatttgttttatccactttttttgctatttatttaaatggtcgatcaacttcccacaaactgaggaatgaattccacgagcctgttctgaaaatgtggacgtaagacaaacacgtgctcgtcctttaatggagttcaccagcacacttgttaaccagtcctgtttgctttcgtctttttttgtgcgtaataaagtcaactgaccaagtgaccatgaaaaggggctgtctggggctcctgttttttagctgctgttcttcagctccgaccatgttgctgtgtgattatctcaattggttttaattgaggcagaaactgaagctctaccaatgaactgtttagaaacaagacacacttttgtattaaaattgcttgcagtaacaaatattttgtatttcctgattttcttttcaactattaccttatctataaatgttaccctggggtataatcatgttgtaggtacttaaatgcattccgcaaatcaaaatatcttgatggataaattatagagcttaatagatcttgttttatttcaaaaaaaaaaaaaaaaaaaaaaaaaaaaaaaaaaaaaaaaaaaaaaaaaaaaaaaaaa

SEQ ID NO: 404 - protein, 5430 aa, Homo sapiens
MSSSDEETLSERSCRSERSCRSERSYRSERSGSLSPCPPGDTLPWNLPLHEQKKRKSQDSVLDPAERAVVRVADERDRVQKKTFTKWVNKHLMKVRKHINDLYEDLRDGHNLISLLEVLSGIKLPREKGRMRFHRLQNVQIALDFLKQRQVKLVNIRNDDITDGNPKLTLGLIWTIILHFQISDIYISGESGDMSAKEKLLLWTQKVTAGYTGIKCTNFSSCWSDGKMFNALIHRYRPDLVDMERVQIQSNRENLEQAFEVAERLGVTRLLDAEDVDVPSPDEKSVITYVSSIYDAFPKVPEGGEGISATEVDSRWQEYQSRVDSLIPWIKQHTILMSDKTFPQNPVELKALYNQYIHFKETEILAKEREKGRIEELYKLLEVWIEFGRIKLPQGYHPNDVEEEWGKLIIEMLEREKSLRPAVERLELLLQIANKIQNGALNCEEKLTLAKNTLQADAAHLESGQPVQCESDVIMYIQECEGLIRQLQVDLQILRDENYYQLEELAFRVMRLQDELVTLRLECTNLYRKGHFTSLELVPPSTLTTTHLKAEPLTKATHSSSTSWFRKPMTRAELVAISSSEDEGNLRFVYELLSWVEEMQMKLERAEWGNDLPSVELQLETQQHIHTSVEELGSSVKEARLYEGKMSQNFHTSYAETLGKLETQYCKLKETSSFRMRHLQSLHKFVSRATAELIWLNEKEEEELAYDWSDNNSNISAKRNYFSELTMELEEKQDVFRSLQDTAELLSLENHPAKQTVEAYSAAVQSQLQWMKQLCLCVEQHVKENTAYFQFFSDARELESFLRNLQDSIKRKYSCDHNTSLSRLEDLLQDSMDEKEQLIQSKSSVASLVGRSKTIVQLKPRSPDHVLKNTISVKAVCDYRQIEITICKNDECVLEDNSQRTKWKVISPTGNEAMVPSVCFLIPPPNKDAIEMASRVEQSYQKVMALWHQLHVNTKSLISWNYLRKDLDLVQTWNLEKLRSSAPGECHQIMKNLQAHYEDFLQDSRDSVLFSVADRLRLEEEVEACKARFQHLMKSMENEDKEETVAKMYISELKNIRLRLEEYEQRVVKRIQSLASSRTDRDAWQDNALRIAEQEHTQEDLQQLRSDLDAVSMKCDSFLHQSPSSSSVPTLRSELNLLVEKMDHVYGLSTVYLNKLKTVDVIVRSIQDAELLVKGYEIKLSQEEVVLADLSALEAHWSTLRHWLSDVKDKNSVFSVLDEEIAKAKVVAEQMSRLTPERNLDLERYQEKGSQLQERWHRVIAQLEIRQSELESIQEVLGDYRACHGTLIKWIEETTAQQEMMKPGQAEDSRVLSEQLSQQTALFAEIERNQTKLDQCQKFSQQYSTIVKDYELQLMTYKAFVESQQKSPGKRRRMLSSSDAITQEFMDLRTRYTALVTLTTQHVKYISDALRRLEEEEKVVEEEKQEHVEKVKELLGWVSTLARNTQGKATSSETKESTDIEKAILEQQVLSEELTTKKEQVSEAIKTSQIFLAKHGHKLSEKEKKQISEQLNALNKAYHDLCDGSANQLQQLQSQLAHQTEQKTLQKQQNTCHQQLEDLCSWVGQAERALAGHQGRTTQQDLSALQKNQSDLKDLQDDIQNRATSFATVVKDIEGFMEENQTKLSPRELTALREKLHQAKEQYEALQEETRVAQKELEEAVTSALQQETEKSKAAKELAENKKKIDALLDWVTSVGSSGGQLLTNLPGMEQLSGASLEKGALDTTDGYMGVNQAPEKLDKQCEMMKARHQELLSQQQNFILATQSAQAFLDQHGHNLTPEEQQMLQQKLGELKEQYSTSLAQSEAELKQVQTLQDELQKFLQDHKEFESWLERSEKELENMHKGGSSPETLPSLLKRQGSFSEDVISHKGDLRFVTISGQKVLDMENSFKEGKEPSEIGNLVKDKLKDATERYTALHSKCTRLGSHLNMLLGQYHQFQNSADSLQAWMQACEANVEKLLSDTVASDPGVLQEQLATTKQLQEELAEHQVPVEKLQKVARDIMEIEGEPAPDHRHVQETTDSILSHFQSLSYSLAERSSLLQKAIAQSQSVQESLESLLQSIGEVEQNLEGKQVSSLSSGVIQEALATNMKLKQDIARQKSSLEATREMVTRFMETADSTTAAVLQGKLAEVSQRFEQLCLQQQEKESSLKKLLPQAEMFEHLSGKLQQFMENKSRMLASGNQPDQDITHFFQQIQELNLEMEDQQENLDTLEHLVTELSSCGFALDLCQHQDRVQNLRKDFTELQKTVKEREKDASSCQEQLDEFRKLVRTFQKWLKETEGSIPPTETSMSAKELEKQIEHLKSLLDDWASKGTLVEEINCKGTSLENLIMEITAPDSQGKTGSILPSVGSSVGSVNGYHTCKDLTEIQCDMSDVNLKYEKLGGVLHERQESLQAILNRMEEVHKEANSVLQWLESKEEVLKSMDAMSSPTKTETVKAQAESNKAFLAELEQNSPKIQKVKEALAGLLVTYPNSQEAENWKKIQEELNSRWERATEVTVARQRQLEESASHLACFQAAESQLRPWLMEKELMMGVLGPLSIDPNMLNAQKQQVQFMLKEFEARRQQHEQLNEAAQGILTGPGDVSLSTSQVQKELQSINQKWVELTDKLNSRSSQIDQAIVKSTQYQELLQDLSEKVRAVGQRLSVQSAISTQPEAVKQQLEETSEIRSDLEQLDHEVKEAQTLCDELSVLIGEQYLKDELKKRLETVALPLQGLEDLAADRINRLQAALASTQQFQQMFDELRTWLDDKQSQQAKNCPISAKLERLQSQLQENEEFQKSLNQHSGSYEVIVAEGESLLLSVPPGEEKRTLQNQLVELKNHWEELSKKTADRQSRLKDCMQKAQKYQWHVEDLVPWIEDCKAKMSELRVTLDPVQLESSLLRSKAMLNEVEKRRSLLEILNSAADILINSSEADEDGIRDEKAGINQNMDAVTEELQAKTGSLEEMTQRLREFQESFKNIEKKVEGAKHQLEIFDALGSQACSNKNLEKLRAQQEVLQALEPQVDYLRNFTQGLVEDAPDGSDASQLLHQAEVAQQEFLEVKQRVNSGCVMMENKLEGIGQFHCRVREMFSQLADLDDELDGMGAIGRDTDSLQSQIEDVRLFLNKIHVLKLDIEASEAECRHMLEEEGTLDLLGLKRELEALNKQCGKLTERGKARQEQLELTLGRVEDFYRKLKGLNDATTAAEEAEALQWVVGTEVEIINQQLADFKMFQKEQVDPLQMKLQQVNGLGQGLIQSAGKDCDVQGLEHDMEEINARWNTLNKKVAQRIAQLQEALLHCGKFQDALEPLLSWLADTEELIANQKPPSAEYKVVKAQIQEQKLLQRLLDDRKATVDMLQAEGGRIAQSAELADREKITGQLESLESRWTELLSKAAARQKQLEDILVLAKQFHETAEPISDFLSVTEKKLANSEPVGTQTAKIQQQIIRHKALEEDIENHATDVHQAVKIGQSLSSLTSPAEQGVLSEKIDSLQARYSEIQDRCCRKAALLDQALSNARLFGEDEVEVLNWLAEVEDKLSSVFVKDFKQDVLHRQHADHLALNEEIVNRKKNVDQAIKNGQALLKQTTGEEVLLIQEKLDGIKTRYADITVTSSKALRTLEQARQLATKFQSTYEELTGWLREVEEELATSGGQSPTGEQIPQFQQRQKELKKEVMEHRLVLDTVNEVSRALLELVPWRAREGLDKLVSDANEQYKLVSDTIGQRVDEIDAAIQRSQQYEQAADAELAWVAETKRKLMALGPIRLEQDQTTAQLQVQKAFSIDIIRHKDSMDELFSHRSEIFGTCGEEQKTVLQEKTESLIQQYEAISLLNSERYARLERAQVLVNQFWETYEELSPWIEETRALIAQLPSPAIDHEQLRQQQEEMRQLRESIAEHKPHIDKLLKIGPQLKELNPEEGEMVEEKYQKAENMYAQIKEEVRQRALALDEAVSQSTQITEFHDKIEPMLETLENLSSRLRMPPLIPAEVDKIRECISDNKSATVELEKLQPSFEALKRRGEELIGRSQGADKDLAAKEIQDKLDQMVFFWEDIKARAEEREIKFLDVLELAEKFWYDMAALLTTIKDTQDIVHDLESPGIDPSIIKQQVEAAETIKEETDGLHEELEFIRILGADLIFACGETEKPEVRKSIDEMNNAWENLNKTWKERLEKLEDAMQAAVQYQDTLQAMFDWLDNTVIKLCTMPPVGTDLNTVKDQLNEMKEFKVEVYQQQIEMEKLNHQGELMLKKATDETDRDIIREPLTELKHLWENLGEKIAHRQHKLEGALLALGQFQHALEELMSWLTHTEELLDAQRPISGDPKVIEVELAKHHVLKNDVLAHQATVETVNKAGNELLESSAGDDASSLRSRLEAMNQCWESVLQKTEEREQQLQSTLQQAQGFHSEIEDFLLELTRMESQLSASKPTGGLPETAREQLDTHMELYSQLKAKEETYNQLLDKGRLMLLSRDDSGSGSKTEQSVALLEQKWHVVSSKMEERKSKLEEALNLATEFQNSLQEFINWLTLAEQSLNIASPPSLILNTVLSQIEEHKVFANEVNAHRDQIIELDQTGNQLKFLSQKQDVVLIKNLLVSVQSRWEKVVQRSIERGRSLDDARKRAKQFHEAWKKLIDWLEDAESHLDSELEISNDPDKIKLQLSKHKEFQKTLGGKQPVYDTTIRTGRALKEKTLLPEDSQKLDNFLGEVRDKWDTVCGKSVERQHKLEEALLFSGQFMDALQALVDWLYKVEPQLAEDQPVHGDLDLVMNLMDAHKVFQKELGKRTGTVQVLKRSGRELIENSRDDTTWVKGQLQELSTRWDTVCKLSVSKQSRLEQALKQAEVFRDTVHMLLEWLSEAEQTLRFRGALPDDTEALQSLIDTHKEFMKKVEEKRVDVNSAVAMGEVILAVCHPDCITTIKHWITIIRARFEEVLTWAKQHQQRLETALSELVANAELLEELLAWIQWAETTLIQRDQEPIPQNIDRVKALIAEHQTFMEEMTRKQPDVDRVTKTYKRKNIEPTHAPFIEKSRSGGRKSLSQPTPPPMPILSQSEAKNPRINQLSARWQQVWLLALERQRKLNDALDRLEELKEFANFDFDVWRKKYMRWMNHKKSRVMDFFRRIDKDQDGKITRQEFIDGILASKFPTTKLEMTAVADIFDRDGDGYIDYYEFVAALHPNKDAYRPTTDADKIEDEVTRQVAQCKCAKRFQVEQIGENKYRFGDSQQLRLVRILRSTVMVRVGGGWMALDEFLVKNDPCRARGRTNIELREKFILPEGASQGMTPFRSRGRRSKPSSRAASPTRSSSSASQSNHSCTSMPSSPATPASGTKVIPSSGSKLKRPTPTFHSSRTSLAGDTSNSSSPASTGAKTNRADPKKSASRPGSRAGSRAGSRASSRRGSDASDFDLLETQSACSDTSESSAAGGQGNSRRGLNKPSKIPTMSKKTTTASPRTPGPKR

SEQ ID NO: 405 - DNA, 11884 bp, Homo sapiens
cgcgcagggagagagcggagggggaggcgacgcgcgccgggaggaggggggacgcagtgggcggagcggagacagcaccttcggagataatcctttctcctgccgcagagcagaggagcggcgggagaggaacacttctcccaggctttagcagagccggcaggatggcgaccgtggtggtggaagccaccgagccggagccatcgggcagcatcggcaacccggcggcgaccacctcgcccagcctgtcgcaccgcttcctagacagcaagttctacttgctggtggtggtcggcgagacggtgaccgaagagcacctgaggcgtgccatcggcaacatcgagctggggatccgatcgtgggacacaaacctgatcgagtgcaacttggaccaagagctcaaacttttcgtgtctcgacactccgcgagattctctcctgaagttccaggacaaaagatcctccatcaccgaagtgacgtcttagaaactgtagttctgatcaacccttcggatgaagcagtcagcaccgaggtgcgtttgatgatcactgacgccgcccgccataaactgctggtgctcaccggacagtgctttgagaacactggagagctcatcctccagtcaggctctttctccttccagaacttcatagagattttcaccgaccaagagattggggagctcctaagcaccacccatcctgccaacaaagccagcctcaccctcttctgccctgaggaaggagactggaagaactccaaccttgacagacacaatctccaagacttcatcaacatcaagctcaactcagcttctatcttgccagaaatggagggactttctgagttcaccgagtacctctcggagtctgtcgaagtcccctccccctttgacatcctggagcccccgacctcgggcggatttctgaagctctccaagccttgttgttacatttttccggggggccgcggggactctgccctgttcgcagtgaacggattcaacatgctcattaacggaggatcagaaagaaagtcctgcttctggaagctcattcggcacttggaccgggtggactccatcctgctcacccacattggggatgacaacttgcccgggatcaacagcatgttgcaacgcaagattgcagagctggaagaggagcggtcccagggctccaccagcaacagtgactggatgaaaaacctcatctcccctgacttgggggttgtgtttctcaatgtacctgaaaatctgaaaaacccagaacccaacatcaagatgaagagaagtacagaagaagcatgcttcaccctccagtacctaaacaaactgtccatgaaaccagagcctttatttagaagtgtaggcaatgccattgagcctgtcatcctgttccaaaaaatgggagtgggtaaactggagatgtacgtgcttaacccagtcaaaagcagcaaggaaatgcagtatttcatgcagcagtggactggaaccaacaaagacaaggctgaacttatcctgcccaatggtcaagaagtagacatcccgatttcctacctgacttccgtctcgtctttgattgtgtggcacccagccaaccctgctgagaaaatcatccgggttctgtttcctggaaacagcacccagtacaacatcctagaagggctggaaaaactcaaacatctagacttcctaaagcagccactggccacccaaaaagatctcactggccaggtgtccacccccccagtgaaacaggtcaagttgaaacagcgggctgacagccgagagagtctgaagccagccacaaaaccactttccagtaaatcagtgaggaaggagtccaaagaggaggcccctgaagccacaaaagccagccaagtggaaaaaacacccaaagttgaaagcaaagagaaagtgatagtgaaaaaagacaagccaggaaaggtagaaagtaagccatcggtgacggaaaaggaggtgcccagcaaagaggagcagtcgcccgtcaaagctgaggtggctgagaaggcggccacggagagcaaacccaaagtcaccaaagacaaagtggtaaaaaaggaaataaagacaaaacccgaagaaaagaaagaggagaagcccaagaaggaagtggctaaaaaggaagacaaaactcccctcaagaaagacgagaagcccaaaaaggaagaggcgaagaaggagatcaagaaagaaatcaaaaaggaagagaaaaaggagctgaagaaagaggtgaagaaggaaacgcccctgaaggacgccaagaaggaggtgaagaaagacgagaagaaagaagttaaaaaggaagagaaggaacccaaaaaggagattaagaagatctccaaggacataaagaaatccactcctctgtcagacacaaagaaaccggctgcattgaaaccaaaagtagcaaagaaagaagagcccaccaagaaggagcctattgctgctgggaaactcaaggacaaggggaaggtcaaagtcattaaaaaggaaggcaagaccacagaggccgctgccacagctgttggcactgctgccgtggctgcagcagccggagtagcggccagcggtcctgccaaagaacttgaagctgagcggtccctcatgtcgtcccctgaggatctaaccaaggactttgaggagctaaaggctgaggagatcgatgtagcgaaggacatcaagcctcagctggagctcattgaagatgaagagaaactgaaggaaaccgagccgggagaagcctacgtcattcagaaagagacggaagtcagcaaaggttctgctgagtcacctgatgaagggatcaccaccactgagggggaaggggagtgcgagcaaacccccgaggagctggagccagttgagaagcagggcgtggatgacatcgagaagttcgaggatgaaggcgctggttttgaagaatcctcagaggccggagactacgaagagaaggcagaaactgaggaggccgaggagccggaagaagacggggaagacaatgtgagcgggagcgcctcgaagcacagccccacagaagacgaagaaatcgctaaggctgaggcggacgtacacatcaaggagaagagggagtctgtggccagcggcgatgaccgggccgaagaagacatggatgaagcgcttgagaaaggagaagctgaacagtctgaggaggagggtgaggaggaggaggacaaagcagaggacgccagagaggaagaccatgagcccgacaaaactgaggctgaagattatgtgatggctgtggttgacaaggccgcggaggccggagtcaccgaggatcagtatgatttcctggggacaccggccaagcaacctggagtccagtctcctagccgagaacccgcgtcttcaattcatgatgagaccctacccggaggctccgagagcgaggccactgcttcagatgaggagaatcgagaagaccagcctgaggaattcactgctacctccggatatactcagtccaccatcgagatatctagtgagccgactccaatggatgagatgtccactcctcgagatgtgatgaccgacgagaccaacaatgaggagacagagtccccgtctcaggagttcgtgaacattaccaaatacgagtcttcgctgtactctcaggagtactccaaacctgtggttgcatcattcaatggattgtcagacgggtcaaagacagacgccactgacggtagggattacaacgcttccgcctccaccatatcaccaccttcgtccatggaagaagacaaattcagcaagtctgctcttcgtgacgcttaccgcccagaagagacggacgtgaaaaccggtgccgagttggacatcaaagatgtttcggatgagagacttagcccagccaagagtccatccctgagtccttctccaccatcacccatagagaagactcccctgggtgaacgtagcgtgaatttctctctgacacccaacgagatcaaagcctctgcagagggagaggcaacagcagtagtgtcccccggagtgacccaagcagtagttgaagaacactgtgccagtcctgaggagaagaccttggaggtagtgtcaccgtctcagtctgtgacaggcagtgcgggccacacaccttactaccaatctcccaccgacgaaaagtccagtcacctacctacagaagtcactgagaacgcgcaggcagtcccggtgagctttgaattcactgaggccaaagatgagaacgagaggtcgtccatcagccccatggatgaacctgtgcctgactcagagtctcctatcgagaaagttctgtctccgttacgcagccctccccttattggatccgagtccgcatatgaagacttcctgagtgcggatgacaaggctcttggcagacgttcagaaagcccctttgaagggaagaatggaaagcaaggcttctcagacaaagaaagcccagtttctgacctgacttccgatctttaccaagacaagcaggaagagaaaagcgcgggcttcataccgataaaggaagactttagtccagaaaagaaagccagcgatgctgaaatcatgagttctcaatcagctctggctttggatgaaaggaaactgggaggagatggatctccaacgcaagtagatgtcagtcagtttggctctttcaaagaagacaccaagatgtccatttcggaaggcaccgtttcagacaagtccgccacgcctgtggatgagggcgtggccgaagacacctattcacacatggaaggtgtggcctcagtgtcaaccgcctctgtggctaccagctcgtttccagagccaaccacagatgacgtgtctccttctctccacgctgaagtgggctctccacattccacagaggtggatgactccctgtcggtgtcggtggtgcaaacaccaactactttccaggaaacagaaatgtctccgtctaaagaagagtgcccaagaccaatgtcgatttctcctcctgacttctcccctaagacagccaaatccaggacaccagttcaagatcaccgatccgaacagtcttcaatgtctattgaattcggtcaggaatcccccgagcattctcttgctatggactttagtcggcagtctccagaccaccctactgtgggtgctggtatgcttcacatcaccgaaaatgggccaactgaggtggactacagtccctccgatatccaggactctagtttgtcacataagattccgccgacagaagagccatcctacacccaggataatgatctgtccgagctcatctctgtgtctcaggtggaggcttccccatccacctcttctgctcacactccttctcagatagcctctcctcttcaggaagacactctctctgatgtcgttcctcccagagatatgtccttatatgcctcgcttgcgtctgagaaagtgcagagcctggaaggagagaaactctctccaaaatccgatatttctccgctcacccctcgagagtcctcacctacatattcacctggcttttcagattctacctctggagctaaagagagtacagcggcttaccaaacctcctcttccccaccaatagatgcagcagccgcagagccctacggcttccgctcctcaatgttatttgatacaatgcagcatcacctggccttgagtagagatttgaccacatctagtgtggagaaggacaatggagggaagacacccggtgactttaactatgcctatcaaaagcccgagagcaccaccgaatccccagatgaagaagattatgactatgaatctcacgagaaaaccatccaggcccacgatgtgggtggttactactatgagaagacagagagaaccataaaatccccatgtgacagtggatactcctatgagaccattgagaagaccaccaagaccccagaagatggtggctactcctgtgaaattaccgagaaaaccactcggacccctgaagagggcgggtactcgtatgagatcagcgagaagacaacacgaacccctgaagtaagtggctacacctatgagaagaccgagaggtccagaaggctcctcgatgacattagcaatggctacgatgacactgaggatggtggccacacacttggcgactgtagctattcctacgaaaccactgagaaaattaccagctttcctgaatctgaaagctattcctatgagacaactacaaaaacaacacggagtccagacacctctgcatactgttacgagaccatggagaagatcaccaagaccccacaggcatccacatactcctatgagacctcagaccgatgctacactccagaaaggaagtccccctcggaggcacgccaggatgttgacttgtgtctggtgtcctcctgtgaattcaagcatcccaagaccgagctctcaccttccttcattaatccaaaccctctcgagtggtttgctggggaagagcccactgaagaatctgagaagcctctcactcagtctggaggagcccccccaccttcaggaggaaaacaacagggcagacaatgcgatgaaactccacccacctcagtcagtgagtcagctccatcccagacggactctgatgttcccccagagacagaagagtgcccctccatcacagctgatgccaacattgactctgaagatgagtcagaaaccatccccacagacaaaacggttacgtacaaacacatggacccgcctccagcccccatgcaagaccgaagcccttctcctcgccaccctgatgtgtccatggtggatccagaggccttggctattgagcagaacctaggcaaggctctgaaaaaggatctgaaggagaaggccaagaccaagaaaccaggcacaaagaccaagtcctcttcacctgtcaaaaagggtgatgggaagtccaagccttcagcagcttcccccaaaccaggagccttgaaggaatcctctgacaaggtgtccagagtggcttctcccaagaagaaagagtctgtggagaaagctatgaagaccaccaccactcctgaggtcaaagccacacgaggggaagagaaggacaaggaaactaagaatgcagccaatgcttctgcatccaagtcagtgaagactgcaacagcaggaccaggaaccactaagacggccaagtcgtccaccgtgcctcccggcctccctgtgtatttggacctctgctatattcccaaccacagcaacagtaagaatgtcgatgttgagtttttcaagagagtgaggtcatcttactacgtggtgagtgggaacgaccctgccgcggaggagcccagccgggctgtcctggatgccttgttggaagggaaggctcagtggggaagcaacatgcaggtgactctgatcccaacacatgactctgaggtgatgagggagtggtaccaggagacccacgagaagcagcaagacctcaacatcatggtcctagcaagcagtagtacagtggtcatgcaagacgagtccttccctgcatgcaagatagaactgtagaaaccgcagccgaccacaccacaggatttgaactgtgtttccagaaattcctgaatttgaaactaccttttcttaaacgtccattcatctaattacgtcactgaacaaggacctgccagatgctatacagtgtcatggtgatgcaaatcactgatatttctcaatttttgccgaccgctaaggaaagtaaccatattcccacaatagatttcaagttactgcaaaattacctacccccgttcatctctgctgaaatacgtggaagccaggcactcgcacacccaactgacttctgctaggtattggcatttatcttagagagagaaagagagagggaaagagagtcagcgggaggggagggagagcggcgggagagagggacaaagagactgccggagagagagagagtgagagtgagagaggaagaatcagaaagaaaaagaatgcaagacaaaaaaggtagagagttctgatgagatgcccagggagaaagagtgggcaggatggggtatagagaagacaccagcaactgggtctgcgttttcccagaccacagcgattcattctgtggtctacacaggtggagttttccattttcaccagagtcatcagaaagagtcgatctcctaaagcttgtttctaaagaacaggaaggacgaagcctgtcacgagggcatgagatttttcacgccttaattaaatgcctttgctataaaggctgcccacgcataatgtagcaagtgtaggctggagaagcgagtggttggagccccgttcagaactctcagacttttcaaacacgtgagtaggttgatctaaggcatgctcccagcatttgtctacccaagtccacatcgagtcaacccgcatgcagcaacacccaaggccaccccagttaactgaagcaaataccaaagcagttgggagaacatatgggagacattttgccttaggaagtgacttgaatgtacaaagttacccgatgcacttattttttaacgtgagacggcaagtttttaaaacatccgtgtaggattgtagatactccaggcgaaggagcatgcggggagggaaggtactagaaactcgtctgactggcccaacagtttagtgcagagtcatgcttggtgaacgtcaccacttctgatgtacccgtggcctctcagccagataagttgcaccctaagtagcttctttaacgcttcaagtttaagactgaaatggcttctctaatcagaaccagggaaacaatgaatctcacggtggaaggggttctcggcaagtgtacagtgtctgccttcctttgtcttgcattgactattttaatttttccattaattccaacacgtgggaacacatgtacagaagatttttttttttagatacatgagaacttttcatagatgaactttctaacgaatgttttcatttacagaaaaatgcaaagaaaaatttgaagcgatggtctttttttttaattattattttaagtgttttgtaagacaaaaaaattgaagttttttgaggttctggaaagatttgaagcctgatattgaagtcgtgatgatatttatttaaaaacccgtcactactggaaacggtggtacctcccaccctttgactctcatattatgaaagtgtgagtccgtgctgtttgagagtgggtaggtggcagggtaggctactgttcagggtttcacagtgctattccctcctcctttcaagattttttcaccgtgaggtggaagagccaagttcagaagcaccctagcgccagcttgcttgggccttttctggaaaacattcattgaaagaaataacagattgaaaacaaatgaattctcagctcctacgttcaccatgtagagagttcagacacaatgtccgtcactgtcatcactgaaccacaaactcgtaacgccagatcatgaggaaatctttcgccaagtttcaaacggcagatccatgtaccaggggttcagagttggcaatcttctcagtgacagccatgacagctcgttcacgctgagtttcctgcagactcttaagatctccggagtagtgaacaatgacctcattttattttctatgttagttatttatttcaaaagttacattttagtttacttttcgtctgtgaagtctatgtttcgcactgctgtttactctgagggtttaacaatatttctccagggtcccctcaccgaggacccatgcagtctacttaatgctgtgaatcacattttccaaatgtttaattttttaaagaaaattaatattctatttttgttaggcgtctctaggaatgcagcttttatttattttcctatttctttccaactcgtaaaagccacacattaaaggtacagaaatgtcctatatggtggaagagacattgagaacggagttcattgagtgtcagctcacttgtttctcacttcaggcaagctgaacacacacaagatggcaatctcatggtagctgttgggttggtccacacaatacactcaaagagaaacagtttctagccttcttgccaaatccagacctctggttgacttttctttcctaaaagatggagttactgcccagttctacagcttaaatttatttagccttttatattattttgttttaaagatgcaaagaccttagaagaaccatagccagccttcagttataaccactcgaccccatacgtcttattgtttatacagaatccgatggggaaaacacttttttttttcaaaactgtcactgatccactggctgtgattcctacacaatctggcagcaccatcctgacccctgtcctcagtgatggccatgtagccgaggacaccagggtgaagtacattggctttgcaggtagctcctgatctcccaggcacccctcctacctgtgtggctgatctgatcttgcttgttccatacatacacaattagtttagaggtagccaccacgatggactatgtacatttgtggtgagagctcaaaaccgacacagacttctagaagatttgtgcatacaatccttgatccaattgtatagattgactatttgagtggaaggcgtttccaccctgtttaaatgatggaattctattgtgctagcactcccgatcatgacccttttggtagtatttgtaaacaaaattctacagagactaaatcttagagataatcctccatttcaattttaatcaattctgtcctccttttttccaaaccccgaaccccatgcatgctttcccagtcttgtgatgggactggacacagtgaccgaccccctcgcctcaaacaccattttccatggaattcaaaagaaaaaaattttttttcttaaccttacatatcatagtgaatggtttccccggtgtatatgaatgttttaagtgtttccaatagcttatgaaatttaggagctttctaatactcgttttataaatttaatcatttgctaatggaaattttaccacctcccatttgtgttacaaatcttagctcctggagcggcactacaattcaggagttgttttttctcacctcctctgtcatttgtcacaggaggtccctgcttggcaatgacatttgtgagttaggataatgacgttccttctctcctttttttttcctttcatacttcagatttaggagaaaaagattctgtttccacgtgagaggaactgtaagcttttatcacgtaaccagctgaacaacacaccaaaagcagcctagggatgagcaccgcgctttggtagcgattaggttttattcacctggtattaaaactattcactatttcaaaaatccggaacttttaagaattcatttcaaaggcagcatcaaaaactgaaaaggaagggaaaaaaaaacaacagctaataatcggcttctccgcacgcgtggagctcgcgaaactggagccccggagaagtggctctgctcagccgcccgcccacgccgcggcggtccttgctttccccgcatgcgcccgcaggcagcgtgcagtcctaagcccggctgtggagaagctcactctctctcttgttctgaatggtgtttgtgtcggtctgcctctgtgtatggtattatgtcttataatcctgcatcacttccatcctatccagtcatatctaatgtagaaaaattagtttccagtgaaagtaatatgtagtgcttttatggtatttgtgtgcaatatcccctcttctattgaggatatttgatgtaaaggaaaaaaaaaaagaaaaaagaaactgagttccacaataaaatacaaagtggcaaaagttcacttgtgtgttgagacatcaaaaaaaaaaaaaaaaaa

SEQ ID NO: 406 - protein, 2461 aa, Homo sapiens
MATVVVEATEPEPSGSIGNPAATTSPSLSHRFLDSKFYLLVVVGETVTEEHLRRAIGNIELGIRSWDTNLIECNLDQELKLFVSRHSARFSPEVPGQKILHHRSDVLETVVLINPSDEAVSTEVRLMITDAARHKLLVLTGQCFENTGELILQSGSFSFQNFIEIFTDQEIGELLSTTHPANKASLTLFCPEEGDWKNSNLDRHNLQDFINIKLNSASILPEMEGLSEFTEYLSESVEVPSPFDILEPPTSGGFLKLSKPCCYIFPGGRGDSALFAVNGFNMLINGGSERKSCFWKLIRHLDRVDSILLTHIGDDNLPGINSMLQRKIAELEEERSQGSTSNSDWMKNLISPDLGVVFLNVPENLKNPEPNIKMKRSTEEACFTLQYLNKLSMKPEPLFRSVGNAIEPVILFQKMGVGKLEMYVLNPVKSSKEMQYFMQQWTGTNKDKAELILPNGQEVDIPISYLTSVSSLIVWHPANPAEKIIRVLFPGNSTQYNILEGLEKLKHLDFLKQPLATQKDLTGQVSTPPVKQVKLKQRADSRESLKPATKPLSSKSVRKESKEEAPEATKASQVEKTPKVESKEKVIVKKDKPGKVESKPSVTEKEVPSKEEQSPVKAEVAEKAATESKPKVTKDKVVKKEIKTKPEEKKEEKPKKEVAKKEDKTPLKKDEKPKKEEAKKEIKKEIKKEEKKELKKEVKKETPLKDAKKEVKKDEKKEVKKEEKEPKKEIKKISKDIKKSTPLSDTKKPAALKPKVAKKEEPTKKEPIAAGKLKDKGKVKVIKKEGKTTEAAATAVGTAAVAAAAGVAASGPAKELEAERSLMSSPEDLTKDFEELKAEEIDVAKDIKPQLELIEDEEKLKETEPGEAYVIQKETEVSKGSAESPDEGITTTEGEGECEQTPEELEPVEKQGVDDIEKFEDEGAGFEESSEAGDYEEKAETEEAEEPEEDGEDNVSGSASKHSPTEDEEIAKAEADVHIKEKRESVASGDDRAEEDMDEALEKGEAEQSEEEGEEEEDKAEDAREEDHEPDKTEAEDYVMAVVDKAAEAGVTEDQYDFLGTPAKQPGVQSPSREPASSIHDETLPGGSESEATASDEENREDQPEEFTATSGYTQSTIEISSEPTPMDEMSTPRDVMTDETNNEETESPSQEFVNITKYESSLYSQEYSKPVVASFNGLSDGSKTDATDGRDYNASASTISPPSSMEEDKFSKSALRDAYRPEETDVKTGAELDIKDVSDERLSPAKSPSLSPSPPSPIEKTPLGERSVNFSLTPNEIKASAEGEATAVVSPGVTQAVVEEHCASPEEKTLEVVSPSQSVTGSAGHTPYYQSPTDEKSSHLPTEVTENAQAVPVSFEFTEAKDENERSSISPMDEPVPDSESPIEKVLSPLRSPPLIGSESAYEDFLSADDKALGRRSESPFEGKNGKQGFSDKESPVSDLTSDLYQDKQEEKSAGFIPIKEDFSPEKKASDAEIMSSQSALALDERKLGGDGSPTQVDVSQFGSFKEDTKMSISEGTVSDKSATPVDEGVAEDTYSHMEGVASVSTASVATSSFPEPTTDDVSPSLHAEVGSPHSTEVDDSLSVSVVQTPTTFQETEMSPSKEECPRPMSISPPDFSPKTAKSRTPVQDHRSEQSSMSIEFGQESPEHSLAMDFSRQSPDHPTVGAGMLHITENGPTEVDYSPSDIQDSSLSHKIPPTEEPSYTQDNDLSELISVSQVEASPSTSSAHTPSQIASPLQEDTLSDVVPPRDMSLYASLASEKVQSLEGEKLSPKSDISPLTPRESSPTYSPGFSDSTSGAKESTAAYQTSSSPPIDAAAAEPYGFRSSMLFDTMQHHLALSRDLTTSSVEKDNGGKTPGDFNYAYQKPESTTESPDEEDYDYESHEKTIQAHDVGGYYYEKTERTIKSPCDSGYSYETIEKTTKTPEDGGYSCEITEKTTRTPEEGGYSYEISEKTTRTPEVSGYTYEKTERSRRLLDDISNGYDDTEDGGHTLGDCSYSYETTEKITSFPESESYSYETTTKTTRSPDTSAYCYETMEKITKTPQASTYSYETSDRCYTPERKSPSEARQDVDLCLVSSCEFKHPKTELSPSFINPNPLEWFAGEEPTEESEKPLTQSGGAPPPSGGKQQGRQCDETPPTSVSESAPSQTDSDVPPETEECPSITADANIDSEDESETIPTDKTVTYKHMDPPPAPMQDRSPSPRHPDVSMVDPEALAIEQNLGKALKKDLKEKAKTKKPGTKTKSSSPVKKGDGKSKPSAASPKPGALKESSDKVSRVASPKKKESVEKAMKTTTTPEVKATRGEEKDKETKNAANASASKSVKTATAGPGTTKTAKSSTVPPGLPVYLDLCYIPNHSNSKNVDVEFFKRVRSSYYVVSGNDPAAEEPSRAVLDALLEGKAQWGSNMQVTLIPTHDSEVMREWYQETHEKQQDLNIMVLASSSTVVMQDESFPACKIEL

SEQ ID NO: 407 - DNA, 1461 bp, Homo sapiens
ccttcgcgccctttggcaagctcggactcatcttctggggattgccgcagtgacccagtaatgggaagggattgatttccaccttgcggggtatggggcgctcttaggaggactctggagaagtagttgtcctgggagaggagcgatcttaatcctgctgcatgacgggaggacaaaatgcgacgctgcagctattttccaaaggacgttacggtgtttgataaggacgataagtctgaaccaatcagagtccttgtgactggagcagctggtcaaattgcatattcactgctgtacagtattggaaatggatctgtctttggtaaagatcagcctataattcttgtgctgttggatatcacccccatgatgggtgtcctggacggtgtcctaatggaactgcaagactgtgcccttcccctcctgaaagatgtcatcgcaacagataaagaagacgttgccttcaaagacctggatgtggccattcttgtgggctccatgccaagaagggaaggcatggagagaaaagatttactgaaagcaaatgtgaaaatcttcaaatcccagggtgcagccttagataaatacgccaagaagtcagttaaggttattgttgtgggtaatccagccaataccaactgcctgactgcttccaagtcagctccatccatccccaaggagaacttcagttgcttgactcgtttggatcacaaccgagctaaagctcaaattgctcttaaacttggtgtgactgctaatgatgtaaagaatgtcattatctggggaaaccattcctcgactcagtatccagatgtcaaccatgccaaggtgaaattgcaaggaaaggaagttggtgtttatgaagctctgaaagatgacagctggctcaagggagaatttgtcacgactgtgcagcagcgtggcgctgctgtcatcaaggctcgaaaactatccagtgccatgtctgctgcaaaagccatctgtgaccacgtcagggacatctggtttggaaccccagagggagagtttgtgtccatgggtgttatctctgatggcaactcctatggtgttcctgatgatctgctctactcattccctgttgtaatcaagaataagacctggaagtttgttgaaggtctccctattaatgatttctcacgtgagaagatggatcttactgcaaaggaactgacagaagaaaaagaaagtgcttttgaatttctttcctctgcctgactagacaatgatgttactaaatgcttcaaagctgaagaatctaaatgtcgtctttgactcaagtaccaaataataataatgctatacttaaattacttgtgaaaaacaacacattttaaagattacgtgcttcttggtacaggtttgtgaatgacagtttatcgtcatgctgttagtgtgcattctaaataaatatatattcaaatgaaaaaaaaaaaaaaaaaa

SEQ ID NO: 408 - protein, 352 aa, Homo sapiens
MRRCSYFPKDVTVFDKDDKSEPIRVLVTGAAGQIAYSLLYSIGNGSVFGKDQPIILVLLDITPMMGVLDGVLMELQDCALPLLKDVIATDKEDVAFKDLDVAILVGSMPRREGMERKDLLKANVKIFKSQGAALDKYAKKSVKVIVVGNPANTNCLTASKSAPSIPKENFSCLTRLDHNRAKAQIALKLGVTANDVKNVIIWGNHSSTQYPDVNHAKVKLQGKEVGVYEALKDDSWLKGEFVTTVQQRGAAVIKARKLSSAMSAAKAICDHVRDIWFGTPEGEFVSMGVISDGNSYGVPDDLLYSFPVVIKNKTWKFVEGLPINDFSREKMDLTAKELTEEKESAFEFLSSA

SEQ ID NO: 409 - DNA, 1520 bp, Homo sapiens
gccgcgcggggccatttccgctgctgcttctgtgagtttttccggtgcacgcgagtgcttctgaaacgtcagctgcgctcccctaggagtgctgagcccgcggaaccgcagccatgactgaggctgatgtgaatccaaaggcctatccccttgccgatgcccacctcaccaagaagctactggacctcgttcagcagtcatgtaactataagcagcttcggaaaggagccaatgaggccaccaaaaccctcaacaggggcatctctgagttcatcgtgatggctgcagacgccgagccactggagatcattctgcacctgccgctgctgtgtgaagacaagaatgtgccctacgtgtttgtgcgctccaagcaggccctggggagagcctgtggggtctccaggcctgtcatcgcctgttctgtcaccatcaaagaaggctcgcagctgaaacagcagatccaatccattcagcagtccattgaaaggctcttagtctaaacctgtggcctctgccacgtgctccctgccagcttcccccctgaggttgtgtatcatattatctgtgttagcatgtagtattttcagctactctctattgttataaaatgtagtactaaatctggtttctggatttttgtgttgtttttgttctgttttacagggttgctatcccccttcctttcctccctccctctgccatccttcatccttttatcctccctttttggaacaagtgttcagagcagacagaagcagggtggtggcaccgttgaaaggcagaaagagccaggagaaagctgatggagccaggacagagatctggttccagctttcagccactagcttcctgttgtgtgcggggtgtggtggaattaaacagcattcattgtgtgtccctgtgcctggcacacagaatcattcatacgtgttcaagtgatcaaggggtttcatttgctcttgggggattaggtatcatttggggaggaagcatgtgttctgtgaggttgttcggctatgtccaagtgtcgtttactaatgtacccctgctgtttgcttttggtaatgtgatgttgatgttctccccctacccacaaccatgcccttgagggtagcagggcagcagcataccaaagagatgtgctgcaggactccggaggcagcctgggtgggtgagccatggggcagttgacctgggtcttgaaagagtcgggagtgacaagctcagagagcatgaactgatgctggcatgaaggattccaggaagatcatggagacctggctggtagctgtaacagagatggtggagtccaaggaaacagcctgtctctggtgaatgggactttctttggtggacacttggcaccagctctgagagcccttcccctgtgtcctgccaccatgtgggtcagatgtactctctgtcacatgaggagagtgctagttcatgtgttctccattcttgtgagcatcctaataaatctgttccattttgatgacaaaaaaaaaaaaaaaaaaaaa

SEQ ID NO: 410 - protein, 128 aa, Homo sapiens
MTEADVNPKAYPLADAHLTKKLLDLVQQSCNYKQLRKGANEATKTLNRGISEFIVMAADAEPLEIILHLPLLCEDKNVPYVFVRSKQALGRACGVSRPVIACSVTIKEGSQLKQQIQSIQQSIERLLV

SEQ ID NO: 411 - DNA, 4255 bp, Homo sapiens
ggtctgcgcgcaggtgccgctcggcgcccggcccgcccgttccgccgctgtcgccgccgtcgtgcgtgccgctcggcggaggggacgggcctgcgttctctcctccttcctccccgcctccagctgccggcaggacctttctctcgctgccgctgggaccccgtgtcatcgcccaggccgagcacggaaatctactttcttcaatgtgttaaccaatagtcaggcttcagcagaaaacttcccgttctgcactattgatcctaatgagagcagagtacctgtgccagatgaaaggtttgactttctttgtcaataccacaaaccagcaagcaaaattcctgcctttctaaatgtggtggatattgctggccttgtgaaaggagctcacaatgggcagggcctggggaatgcttttttatctcatattagtgcctgtgatggcatctttcatctaacacgtgcttttgaagatgatgatatcacgcacgttgaaggaagtgtagatcctattcgagatatagaaataatacatgaagagcttcagcttaaagatgaggaaatgattgggcccattatagataaactagaaaaggtggctgtgagaggaggagataaaaaactaaaacctgaatatgatataatgtgcaaagtaaaatcctgggttatagatcaaaagaaacctgttcgcttctatcatgattggaatgacaaagagattgaagtgttgaataaacacttatttttgacttcaaaaccaatggtctacttggttaatctttctgaaaaagactacattagaaagaaaaacaaatggttgataaaaattaaagagtgggtggacaagtatgacccaggtgctttggtcattccttttagtggggccttggaactcaagttgcaagaattgagtgctgaggagagacagaagtatctggaagcgaacatgacacaaagtgctttgccaaagatcattaaggctgggtttgcagcactccaactagaatactttttcactgcaggcccagatgaagtgcgtgcatggaccatcaggaaagggactaaggctcctcaggctgcaggaaagattcacacagattttgaaaagggattcattatggctgaagtaatgaaatacgaagattttaaagaggaaggttctgaaaatgcagtcaaggctgctggaaagtacagacaacaaggcagaaattatattgttgaagatggagatattatcttcttcaaatttaacacacctcaacaaccgaagaagaaataaaatttagttattgctcagataaacatacaacttccaaaaggcatctgatttttaaaaaattaaaatttctgaaaaccaatgcgacaaataaagttggggagatgggaatctttgacaaacaaattatttttatttgttttaaaattaaaatactgtgtacccccccccccccatgaaatgcaggttcactaaatgtgaacagctttgcttttcacgtgattaagaccctactccaaattgtagaagcttttcaggaaccatattactctcatgatacttcattaatctccatcatgtatgccaagcctgacacatttgacagtgaggacaatgtggcttgctcctttttgaatctacagataatgcatgttttacagtactccagatgtctacactcaataaaacatttgacaaaaccagccttggtgtgtttggggatgtctgtattgactgactgtggtgtgctgaatgcgatacggcacctggtggttgctgattacagaattttaaggcgtgtgtatgacacagtaactggcagtgtggggcagctgcaattgtatcttaaaagtgagtctttcatgggaatcagaagaatagtataccagggatttgtctcaaaaaagttaattaatttatagatcaacatttattgaaagatgatagcaatgatattatgagggatatgagataggtgactgaccacaaagaagaaaattctgtctcaaaaattaaagaattttgtttgttattgttgttctgaccatattgaaaagaggttcacttttaatctttcctttgaaattattaaattgtaaaaactgacccattgatgtctggtgggttatgttttgcttcaattcagcaatgtgtataaaagttcctacactgattttgaaatactaagatcagactttgaaaattttaaaaattctttcattcttacttttcagatatttgagagcagtcgaagtggtagtatgggtaagttaagcacttcttaacattgtagcagaaaattccaaaagaaagactagaacaaattggtaatttggagaccctttgccacttagccttctcttgtgatgatggcctgaaagctctctcggccctgagcctccctttctctcccatgtttccattcctgtgagacctcccttccttgtccttgtcctctgcccttttgtgctcttctgtgatcacaggaccatttccatggaatgcagattcatacccagccagcctttgcctctactgtatcgctttgggactttaaagatgcagaagtattagaacacacacaaacttaaaatggaaagttaccaaatgtagcactagaggcaagaaaaggggtgattttttaaagatttggctatacttaagatatttaaagaggatgaggttgagtcgtgagtataatttagaagctctccagtgagtatttttttagtatcaaatagtgatcttcttttgctaacataaaaatgagtaaactacagcagagaaataagaataaaactaatgaagggttttttaaaagaactaaataaaacaaataaaactaggctacaggtatagctgaccaagtttgctgtgaaaaatccttgttatatctatttctgtattggagtaatgtgtagattagtggattgttagggatttcagcagtataagaaagaatcaaatatcttgcttttgggtcttctccaaagtaaattgcatggacttcttaaagaagtttgaaatcagtaaaaagacattaggatcatgcaattttactttgtctagcttctaatgtggtaaattgcacattgtgcaacagaaccattaataaaagaaaggagttagttttgaggtaactgcattcattaggggctgaaaataaatgttaaaaatgtttaatttggttagaagttctacaacattgtatgtacatatacaaaatttcattttctctgaaagtcgagaattccaagaactgttacatataatcatatatatgcctatatctaaacgttttccctcctttaatattgataaagttaatatattttaggatgttatgtaaatatttttgcatgtatctgtagctccatcttaatcaaatttatggttaaaagagatttgaggccaggcgtggaggctcacacctataatcccaacactttgggaggccgaggtgggaggatcacttgagcacaggagtttgagaccagcctgtgcaacatcatgaaacatcatctctacataaaaaaatacatatatacaaaaattagctgggcatcatggcacacacctgtagtcccagctacttaggaggctgagatgggaggattgatcgatcgcttgagcctgggaggtggaggctactgtgagccatgatcatgccactgcactccagcctgggcaacagagtgagaccctgtctccaaagagaaagagaaacttgagaaggcttgtgcccaaagcttgaagaaagattgtaatagcatttagttgtgttttatcatgttatcttcataacatgcattttgcatatggctcagagcagagccggatctcccaaggaagcacaaatagtttttgtcgctaacttagttatgagtgaagcctctgttcacttataacttgccagtttcattggtggaataagtccccttactcatgattcatcaatattcctatattaaaattccagtttgatgtttgtctctagttgtctgtgtataatatttccaaagctcctttgtaaaccccgtctcctttcattcagagagtcagagacggtatctcctcctcctgcctcttctattgttctgattagtctacttaaattcacttgatgctctttttattttacaagagacttgagaaatgtcggttgttcctaatggcaaactactttagctgggaaaattcatttcaacttattttaagcttgtaaaatacactgtggtgataaaataaaagagctgggtttga

SEQ ID NO: 412 - protein, 238 aa, Homo sapiens
MIGPIIDKLEKVAVRGGDKKLKPEYDIMCKVKSWVIDQKKPVRFYHDWNDKEIEVLNKHLFLTSKPMVYLVNLSEKDYIRKKNKWLIKIKEWVDKYDPGALVIPFSGALELKLQELSAEERQKYLEANMTQSALPKIIKAGFAALQLEYFFTAGPDEVRAWTIRKGTKAPQAAGKIHTDFEKGFIMAEVMKYEDFKEEGSENAVKAAGKYRQQGRNYIVEDGDIIFFKFNTPQQPKKK

SEQ ID NO: 413 - DNA, 5249 bp, Homo sapiens
cttccctccccgactgtgcgccgcggctggctcgggttcccgggccgacatgggcgccgccgcgtgggcacggccgctgagcgtgtctttcctgctgctgcttctgccgctcccggggatgcctgcgggctcctgggacccggccggttacctgctctactgcccctgcatggggcgctttgggaaccaggccgatcacttcttgggctctctggcatttgcaaagctgctaaaccgtaccttggctgtccctccttggattgagtaccagcatcacaagcctcctttcaccaacctccatgtgtcctaccagaagtacttcaagctggagcccctccaggcttaccatcgggtcatcagcttggaggatttcatggagaagctggcacccacccactggccccctgagaagcgggtggcatactgctttgaggtggcagcccagcgaagcccagataagaagacgtgccccatgaaggaaggaaacccctttggcccattctgggatcagtttcatgtgagtttcaacaagtcggagctttttacaggcatttccttcagtgcttcctacagagaacaatggagccagagattttctccaaaggaacatccggtgcttgccctgccaggagccccagcccagttccccgtcctagaggaacacaggccactacagaagtacatggtatggtcagacgaaatggtgaagacgggagaggcccagattcatgcccaccttgtccggccctatgtgggcattcatctgcgcattggctctgactggaagaacgcctgtgccatgctgaaggacgggactgcaggctcgcacttcatggcctctccgcagtgtgtgggctacagccgcagcacagcggcccccctcacgatgactatgtgcctgcctgacctgaaggagatccagagggctgtgaagctctgggtgaggtcgctggatgcccagtcggtctacgttgctactgattccgagagttatgtgcctgagctccaacagctcttcaaagggaaggtgaaggtggtgagcctgaagcctgaggtggcccaggtcgacctgtacatcctcggccaagccgaccactttattggcaactgtgtctcctccttcactgcctttgtgaagcgggagcgggacctccaggggaggccgtcttctttcttcggcatggacaggccccctaagctgcgggacgagttctgattctggccggagcaccagaccctctgatcctggagggaccagagtctgagctggtccttccagccaggcctggcagccagaggtgctccgggattgcaaactcctcttctcacctgccaaagatggagaagagtgccagggacccctcaaggagggagacgctccatatcccagggcataggacttgcaggttcctaggagcaggagcatctcccatcgcacgtgctttctgctcttctgggaatttctcacactggcaaagcagtccagcctccgtcttctggtccactctgctctgagcagcctgggatgctgaactcttcagagagatttttttatagagagatttctataattttgatacaaggtcatgactatcctagaactctctgtggtttttgaaaatcattgaattctattaatgtaggtacctaaagtgaccttaactgaatgtggatgaggctggggctggtgtgggtcttttggctgcttttcaaggtgtcccccaatgtggccctcaagagccatccccactgcctggccagagccattgttgtcccctacttcctaggccatttctggggcttgggggatgaatgctgtcctgtgctgtaaacactatgcaaatggaagttatcggttgtggtgctgtgcagcgctctgtgggcgactaagtgccactcacgcagcatgttcctggcaaggagcacataccatcaagccacactatcatggtattgttctcacagtcttttggtggttgatggccactgcaaacctggcaccatcagatctcttctgatctcttgccccagtggggcctggttggtagaatgttggcattcggttgatatccaaagcctgttctcccagccgtcctcctgcagctggagccttcaggccgtattctcacgagggaacgtttgccaaggctctgacctcacagaagatgcccagggcccagaagccatcagaattatcagtggagaagcaccttttgactcttcccttccaatgtaatctctgccaacaccatgaggcttaaggtgctctaagtcatgagtgttttggtctcaaatgctgcagttttaataatctgtgactcctgagagcccatggttttttgaccttgtggttctaaaattccttgtctgacccctgtagatcttttccttgccatgtcacctcccttggcctttgatcctggaaaggtggcagagcctccactgagccaggcccagagctccttgcagtgccttcttccttgtttacctgtgggaggaaacactttttttgtcaggggcagcctggttcagagctcagaggtcacactgtatcaaagatctcaaacagcaaagtcagcatttgctgtatagagctgccacccaactctaagcaggagaaactgtacagaaagggctttgctatttttcccttttgggaaaacaatgaagtgttttaagtcctgggtggactgagagatggtttgcctgtccagacttgctctcaagcctcatccagagaaggagctgcagatgagggagcccgtacactccctgccaccactaggttgtaagcctgtagctggctggctgatttcattttggaattcatttgccatccacagccttacactaggcacacactttagagtctggggctccagtggggcccgcctaattttttttccccccaagacagggccttgctctgtctcccaggctggagtgcagtggcatgatcatggcttactgcagccttgatctcccaggctcaagcgatccttctgcctcagcctctctggtagctgagactgcatgcccagctccaaatcaccttgattcatatcagcagtaataatcacttgtgttctgaaagaaagggcaccagaagttctagcaaaattcagttgtgttctgtgagctagcactttttcctctgacccaattttcttacctataaaatggtgataaaaaccgacaggttgttcaaaggcccagatcagctaaagcatgtatataagagcacgttgtaaacttgaaagagacaaaggcacaaatgtggctgttgattaatttgactgcttctcgttgctcgtcacctccatgccaggcactgtgcttgctaattgctttatgggggcattctcttatttattccccagccctgggaaataggagctgtcattatccttctctttctgcacaaggaaaaattaatgccctgagaattgtcataattttcccaaggctgcccagctggtggtgttaagccagaatttgacctcccagagccagtttccattagctgccatgctctgctgcctctaattcacagaatgcactttctaccctgtgtgccatggagacctcctatggaaaaatgatcagccaccttaccttctactgggtacctgctgtgagtctgcctatgccagaaggattaaggaggggaggttacccaagaaacaaagcctacatgccgcttacagcccccgttggatggttgctcagtacaacagtcttgcattcagcaggtgtttgttcatcacctactatgtgtcaggctctatgctaggtactggggatacaggagagaatcaagcgtaaagtctttgttctcaaggaatttgcattctagaaagtagaagatgtaataaatgtactgtgggacatgttaataagtgctataaagaaatataaagggtttgggagcaaaaagagggagtggatctattttagatgagcccaggtaagacctctctgaagagctgtcatgaaggagggagggagcacattcctggcagagaaaacagcacgtgcaaaggccccgagactggagtgtgttcctgaagagcagccaggaggccagcatggctggagaggcaggcataggcagggaaccgagcagcaggtcagagcaggcgagctgacattctgcagcctggacggccatggcaggaagcttttagttggagagatacaggaagcctcctagggttctgagcagaagaggggcatgagctgattcacattctgaaggacctctctagctggccagtgctgaggaggttggagagagaaagggtgaaagcagagagaccagtgcagggctgttaacagggttgcaggcgagagactggggtgctgggctcccctagactaggactccagtgccctcctctcccaagagacaaaggccattgcattgaaggaggtgggaaatgattagattctgaacatatgtaattatttttcagtctttttcaaagatacaaatatttacatagttttaatcatgtaatatatacaatttaatgtcctagtgttttacttaatagtgtatcatgttttccctgttggtatgtagcctggataaatgctcttaattataaaaaattctgtcgaggagtgttccatagtttattgttttcctattatgagaatttaggccaagtgtggtggctcatgcctgtaatcccagcactttgcgaggccgaggtgggcagatcacttgaggtgaggagttcaagaccagcctggccaacatggtgaattatctctactaaaaatacaaaaaaataataataatagccaggcgtggtggcacatgcctgtattcccagctgcttgggaggctgaggcaggagaatggcttgaacctgggaggtggaggttgcagtgagccgagatggtgccactgcattccagcctgggcaacagagcgagactccatctcaaaaaaaaggagacttcatgtgcccccaatttttcactattgttatttgaaaaaatatttttatttgtaagagtttttctttatttaaaatgttcattaataaagttgttggacgggaagcaaaaaaaaaaagttgtttaagataaattcccagaagtgaatttgttagatcaaacacttaaaactttttgttatggaagaattcaaatataaataaaaaattgtgagtaataaaatgaactcacagtttcaacaatgacccacaaaaaaaaaaaaaaaaaaaaaaaaaaaaaaa

SEQ ID NO: 414 - protein, 388 aa, Homo sapiens
MGAAAWARPLSVSFLLLLLPLPGMPAGSWDPAGYLLYCPCMGRFGNQADHFLGSLAFAKLLNRTLAVPPWIEYQHHKPPFTNLHVSYQKYFKLEPLQAYHRVISLEDFMEKLAPTHWPPEKRVAYCFEVAAQRSPDKKTCPMKEGNPFGPFWDQFHVSFNKSELFTGISFSASYREQWSQRFSPKEHPVLALPGAPAQFPVLEEHRPLQKYMVWSDEMVKTGEAQIHAHLVRPYVGIHLRIGSDWKNACAMLKDGTAGSHFMASPQCVGYSRSTAAPLTMTMCLPDLKEIQRAVKLWVRSLDAQSVYVATDSESYVPELQQLFKGKVKVVSLKPEVAQVDLYILGQADHFIGNCVSSFTAFVKRERDLQGRPSSFFGMDRPPKLRDEF

SEQ ID NO: 415 - DNA, 13416 bp, Homo sapiens
ggggcatttccgggtccgggccgagcgggcgcacgcgcgggagcgggactcggcggcatggcgggctccggagccggtgtgcgttgctccctgctgcggctgcaggagaccttgtccgctgcggaccgctgcggtgctgccctggccggtcatcaactgatccgcggcctggggcaggaatgcgtcctgagcagcagccccgcggtgctggcattacagacatctttagttttttccagagatttcggtttgcttgtatttgtccggaagtcactcaacagtattgaatttcgtgaatgtagagaagaaatcctaaagtttttatgtattttcttagaaaaaatgggccagaagatcgcaccttactctgttgaaattaagaacacttgtaccagtgtttatacaaaagatagagctgctaaatgtaaaattccagccctggaccttcttattaagttacttcagacttttagaagttctagactcatggatgaatttaaaattggagaattatttagtaaattctatggagaacttgcattgaaaaaaaaaataccagatacagttttagaaaaagtatatgagctcctaggattattgggtgaagttcatcctagtgagatgataaataatgcagaaaacctgttccgcgcttttctgggtgaacttaagacccagatgacatcagcagtaagagagcccaaactacctgttctggcaggatgtctgaaggggttgtcctcacttctgtgcaacttcactaagtccatggaagaagatccccagacttcaagggagatttttaattttgtactaaaggcaattcgtcctcagattgatctgaagagatatgctgtgccctcagctggcttgcgcctatttgccctgcatgcatctcagtttagcacctgccttctggacaactacgtgtctctatttgaagtcttgttaaagtggtgtgcccacacaaatgtagaattgaaaaaagctgcactttcagccctggaatcctttctgaaacaggtttctaatatggtggcgaaaaatgcagaaatgcataaaaataaactgcagtactttatggagcagttttatggaatcatcagaaatgtggattcgaacaacaaggagttatctattgctatccgtggatatggactttttgcaggaccgtgcaaggttataaacgcaaaagatgttgacttcatgtacgttgagctcattcagcgctgcaagcagatgttcctcacccagacagacactggtgacgaccgtgtttatcagatgccaagcttcctccagtctgttgcaagcgtcttgctgtaccttgacacagttcctgaggtgtatactccagttctggagcacctcgtggtgatgcagatagacagtttcccacagtacagtccaaaaatgcagctggtgtgttgcagagccatagtgaaggtgttcctagctttggcagcaaaagggccagttctcaggaattgcattagtactgtggtgcatcagggtttaatcagaatatgttctaaaccagtggtccttccaaagggccctgagtctgaatctgaagaccaccgtgcttcaggggaagtcagaactggcaaatggaaggtgcccacatacaaagactacgtggatctcttcagacatctcctgagctctgaccagatgatggattctattttagcagatgaagcatttttctctgtgaattcctccagtgaaagtctgaatcatttactttatgatgaatttgtaaaatccgttttgaagattgttgagaaattggatcttacacttgaaatacagactgttggggaacaagagaatggagatgaggcgcctggtgtttggatgatcccaacttcagatccagcggctaacttgcatccagctaaacctaaagatttttcggctttcattaacctggtggaattttgcagagagattctccctgagaaacaagcagaattttttgaaccatgggtgtactcattttcatatgaattaattttgcaatctacaaggttgcccctcatcagtggtttctacaaattgctttctattacagtaagaaatgccaagaaaataaaatatttcgagggagttagtccaaagagtctgaaacactctcctgaagacccagaaaagtattcttgctttgctttatttgtgaaatttggcaaagaggtggcagttaaaatgaagcagtacaaagatgaacttttggcctcttgtttgacctttcttctgtccttgccacacaacatcattgaactcgatgttagagcctacgttcctgcactgcagatggctttcaaactgggcctgagctatacccccttggcagaagtaggcctgaatgctctagaagaatggtcaatttatattgacagacatgtaatgcagccttattacaaagacattctcccctgcctggatggatacctgaagacttcagccttgtcagatgagaccaagaataactgggaagtgtcagctctttctcgggctgcccagaaaggatttaataaagtggtgttaaagcatctgaagaagacaaagaacctttcatcaaacgaagcaatatccttagaagaaataagaattagagtagtacaaatgcttggatctctaggaggacaaataaacaaaaatcttctgacagtcacgtcctcagatgagatgatgaagagctatgtggcctgggacagagagaagcggctgagctttgcagtgccctttagagagatgaaacctgtcattttcctggatgtgttcctgcctcgagtcacagaattagcgctcacagccagtgacagacaaactaaagttgcagcctgtgaacttttacatagcatggttatgtttatgttgggcaaagccacgcagatgccagaagggggacagggagccccacccatgtaccagctctataagcggacgtttcctgtgctgcttcgacttgcgtgtgatgttgatcaggtgacaaggcaactgtatgagccactagttatgcagctgattcactggttcactaacaacaagaaatttgaaagtcaggatactgttgccttactagaagctatattggatggaattgtggaccctgttgacagtactttaagagatttttgtggtcggtgtattcgagaattccttaaatggtccattaagcaaataacaccacagcagcaggagaagagtccagtaaacaccaaatcgcttttcaagcgactttatagccttgcgcttcaccccaatgctttcaagaggctgggagcatcacttgcctttaataatatctacagggaattcagggaagaagagtctctggtggaacagtttgtgtttgaagccttggtgatatacatggagagtctggccttagcacatgcagatgagaagtccttaggtacaattcaacagtgttgtgatgccattgatcacctatgccgcatcattgaaaagaagcatgtttctttaaataaagcaaagaaacgacgtttgccgcgaggatttccaccttccgcatcattgtgtttattggatctggtcaagtggcttttagctcattgtgggaggccccagacagaatgtcgacacaaatccattgaactcttttataaattcgttcctttattgccaggcaacagatcccctaatttgtggctgaaagatgttctcaaggaagaaggtgtctcttttctcatcaacacctttgaggggggtggctgtggccagccctcgggcatcctggcccagcccaccctcttgtaccttcgggggccattcagcctgcaggccacgctatgctggctggacctgctcctggccgcgttggagtgctacaacacgttcattggcgagagaactgtaggagcgctccaggtcctaggtactgaagcccagtcttcacttttgaaagcagtggctttcttcttagaaagcattgccatgcatgacattatagcagcagaaaagtgctttggcactggggcagcaggtaacagaacaagcccacaagagggagaaaggtacaactacagcaaatgcaccgttgtggtccggattatggagtttaccacgactctgctaaacacctccccggaaggatggaagctcctgaagaaggacttgtgtaatacacacctgatgagagtcctggtgcagacgctgtgtgagcccgcaagcataggtttcaacatcggagacgtccaggttatggctcatcttcctgatgtttgtgtgaatctgatgaaagctctaaagatgtccccatacaaagatatcctagagacccatctgagagagaaaataacagcacagagcattgaggagctttgtgccgtcaacttgtatggccctgacgcgcaagtggacaggagcaggctggctgctgttgtgtctgcctgtaaacagcttcacagagctgggcttctgcataatatattaccgtctcagtccacagatttgcatcattctgttggcacagaacttctttccctggtttataaaggcattgcccctggagatgagagacagtgtctgccttctctagacctcagttgtaagcagctggccagcggacttctggagttagcctttgcttttggaggactgtgtgagcgccttgtgagtcttctcctgaacccagcggtgctgtccacggcgtccttgggcagctcacagggcagcgtcatccacttctcccatggggagtatttctatagcttgttctcagaaacgatcaacacggaattattgaaaaatctggatcttgctgtattggagctcatgcagtcttcagtggataataccaaaatggtgagtgccgttttgaacggcatgttagaccagagcttcagggagcgagcaaaccagaaacaccaaggactgaaacttgcgactacaattctgcaacactggaagaagtgtgattcatggtgggccaaagattcccctctcgaaactaaaatggcagtgctggccttactggcaaaaattttacagattgattcatctgtatcttttaatacaagtcatggttcattccctgaagtctttacaacatatattagtctacttgctgacacaaagctggatctacatttaaagggccaagctgtcactcttcttccattcttcaccagcctcactggaggcagtctggaggaacttagacgtgttctggagcagctcatcgttgctcacttccccatgcagtccagggaatttcctccaggaactccgcggttcaataattatgtggactgcatgaaaaagtttctagatgcattggaattatctcaaagccctatgttgttggaattgatgacagaagttctttgtcgggaacagcagcatgtcatggaagaattatttcaatccagtttcaggaggattgccagaaggggttcatgtgtcacacaagtaggccttctggaaagcgtgtatgaaatgttcaggaaggatgacccccgcctaagtttcacacgccagtcctttgtggaccgctccctcctcactctgctgtggcactgtagcctggatgctttgagagaattcttcagcacaattgtggtggatgccattgatgtgttgaagtccaggtttacaaagctaaatgaatctacctttgatactcaaatcaccaagaagatgggctactataagattctagacgtgatgtattctcgccttcccaaagatgatgttcatgctaaggaatcaaaaattaatcaagttttccatggctcgtgtattacagaaggaaatgaacttacaaagacattgattaaattgtgctacgatgcatttacagagaacatggcaggagagaatcagctgctggagaggagaagactttaccattgtgcagcatacaactgcgccatatctgtcatctgctgtgtcttcaatgagttaaaattttaccaaggttttctgtttagtgaaaaaccagaaaagaacttgcttatttttgaaaatctgatcgacctgaagcgccgctataattttcctgtagaagttgaggttcctatggaaagaaagaaaaagtacattgaaattaggaaagaagccagagaagcagcaaatggggattcagatggtccttcctatatgtcttccctgtcatatttggcagacagtaccctgagtgaggaaatgagtcaatttgatttctcaaccggagttcagagctattcatacagctcccaagaccctagacctgccactggtcgttttcggagacgggagcagcgggaccccacggtgcatgatgatgtgctggagctggagatggacgagctcaatcggcatgagtgcatggcgcccctgacggccctggtcaagcacatgcacagaagcctgggcccgcctcaaggagaagaggattcagtgccaagagatcttccttcttggatgaaattcctccatggcaaactgggaaatccaatagtaccattaaatatccgtctcttcttagccaagcttgttattaatacagaagaggtctttcgcccttacgcgaagcactggcttagccccttgctgcagctggctgcttctgaaaacaatggaggagaaggaattcactacatggtggttgagatagtggccactattctttcatggacaggcttggccactccaacaggggtccctaaagatgaagtgttagcaaatcgattgcttaatttcctaatgaaacatgtctttcatccaaaaagagctgtgtttagacacaaccttgaaattataaagacccttgtcgagtgctggaaggattgtttatccatcccttataggttaatatttgaaaagttttccggtaaagatcctaattctaaagacaactcagtagggattcaattgctaggcatcgtgatggccaatgacctgcctccctatgacccacagtgtggcatccagagtagcgaatacttccaggctttggtgaataatatgtcctttgtaagatataaagaagtgtatgccgctgcagcagaagttctaggacttatacttcgatatgttatggagagaaaaaacatactggaggagtctctgtgtgaactggttgcgaaacaattgaagcaacatcagaatactatggaggacaagtttattgtgtgcttgaacaaagtgaccaagagcttccctcctcttgcagacaggttcatgaatgctgtgttctttctgctgccaaaatttcatggagtgttgaaaacactctgtctggaggtggtactttgtcgtgtggagggaatgacagagctgtacttccagttaaagagcaaggacttcgttcaagtcatgagacatagagatgatgaaagacaaaaagtatgtttggacataatttataagatgatgccaaagttaaaaccagtagaactccgagaacttctgaaccccgttgtggaattcgtttcccatccttctacaacatgtagggaacaaatgtataatattctcatgtggattcatgataattacagagatccagaaagtgagacagataatgactcccaggaaatatttaagttggcaaaagatgtgctgattcaaggattgatcgatgagaaccctggacttcaattaattattcgaaatttctggagccatgaaactaggttaccttcaaataccttggaccggttgctggcactaaattccttatattctcctaagatagaagtgcactttttaagtttagcaacaaattttctgctcgaaatgaccagcatgagcccagattatccaaaccccatgttcgagcatcctctgtcagaatgcgaatttcaggaatataccattgattctgattggcgtttccgaagtactgttctcactccgatgtttgtggagacccaggcctcccagggcactctccagacccgtacccaggaagggtccctctcagctcgctggccagtggcagggcagataagggccacccagcagcagcatgacttcacactgacacagactgcagatggaagaagctcatttgattggctgaccgggagcagcactgacccgctggtcgaccacaccagtccctcatctgactccttgctgtttgcccacaagaggagtgaaaggttacagagagcacccttgaagtcagtggggcctgattttgggaaaaaaaggctgggccttccaggggacgaggtggataacaaagtgaaaggtgcggccggccggacggacctactacgactgcgcagacggtttatgagggaccaggagaagctcagtttgatgtatgccagaaaaggcgttgctgagcaaaaacgagagaaggaaatcaagagtgagttaaaaatgaagcaggatgcccaggtcgttctgtacagaagctaccggcacggagaccttcctgacattcagatcaagcacagcagcctcatcaccccgttacaggccgtggcccagagggacccaataattgcaaaacagctctttagcagcttgttttctggaattttgaaagagatggataaatttaagacactgtctgaaaaaaacaacatcactcaaaagttgcttcaagacttcaatcgttttcttaataccaccttctctttctttccaccctttgtctcttgtattcaggacattagctgtcagcacgcagccctgctgagcctcgacccagcggctgttagcgctggttgcctggccagcctacagcagcccgtgggcatccgcctgctagaggaggctctgctccgcctgctgcctgctgagctgcctgccaagcgagtccgtgggaaggcccgcctccctcctgatgtcctcagatgggtggagcttgctaagctgtatagatcaattggagaatacgacgtcctccgtgggatttttaccagtgagataggaacaaagcaaatcactcagagtgcattattagcagaagccagaagtgattattctgaagctgctaagcagtatgatgaggctctcaataaacaagactgggtagatggtgagcccacagaagccgagaaggatttttgggaacttgcatcccttgactgttacaaccaccttgctgagtggaaatcacttgaatactgttctacagccagtatagacagtgagaaccccccagacctaaataaaatctggagtgaaccattttatcaggaaacatatctaccttacatgatccgcagcaagctgaagctgctgctccagggagaggctgaccagtccctgctgacatttattgacaaagctatgcacggggagctccagaaggcgattctagagcttcattacagtcaagagctgagtctgctttacctcctgcaagatgatgttgacagagccaaatattacattcaaaatggcattcagagttttatgcagaattattctagtattgatgtcctcttacaccaaagtagactcaccaaattgcagtctgtacaggctttaacagaaattcaggagttcatcagctttataagcaaacaaggcaatttatcatctcaagttccccttaagagacttctgaacacctggacaaacagatatccagatgctaaaatggacccaatgaacatctgggatgacatcatcacaaatcgatgtttctttctcagcaaaatagaggagaagcttacccctcttccagaagataatagtatgaatgtggatcaagatggagaccccagtgacaggatggaagtgcaagagcaggaagaagatatcagctccctgatcaggagttgcaagttttccatgaaaatgaagatgatagacagtgcccggaagcagaacaatttctcacttgctatgaaactactgaaggagctgcataaagagtcaaaaaccagagacgattggctggtgagctgggtgcagagctactgccgcctgagccactgccggagccggtcccagggctgctctgagcaggtgctcactgtgctgaaaacagtctctttgttggatgagaacaacgtgtcaagctacttaagcaaaaatattctggctttccgtgaccagaacattctcttgggtacaacttacaggatcatagcgaatgctctcagcagtgagccagcctgccttgctgaaatcgaggaggacaaggctagaagaatcttagagctttctggatccagttcagaggattcagagaaggtgatcgcgggtctgtaccagagagcattccagcacctctctgaggctgtgcaggcggctgaggaggaggcccagcctccctcctggagctgtgggcctgcagctggggtgattgatgcttacatgacgctggcagatttctgtgaccaacagctgcgcaaggaggaagagaatgcatcagttattgattctgcagaactgcaggcgtatccagcacttgtggtggagaaaatgttgaaagctttaaaattaaattccaatgaagccagattgaagtttcctagattacttcagattatagaacggtatccagaggagactttgagcctcatgacaaaagagatctcttccgttccctgctggcagttcatcagctggatcagccacatggtggccttactggacaaagaccaagccgttgctgttcagcactctgtggaagaaatcactgataactacccgcaggctattgtttatcccttcatcataagcagcgaaagctattccttcaaggatacttctactggtcataagaataaggagtttgtggcaaggattaaaagtaagttggatcaaggaggagtgattcaagattttattaatgccttagatcagctctctaatcctgaactgctctttaaggattggagcaatgatgtaagagctgaactagcaaaaacccctgtaaataaaaaaaacattgaaaaaatgtatgaaagaatgtatgcagccttgggtgacccaaaggctccaggcctgggggcctttagaaggaagtttattcagacttttggaaaagaatttgataaacattttgggaaaggaggttctaaactactgagaatgaagctcagtgacttcaacgacattaccaacatgctacttttaaaaatgaacaaagactcaaagccccctgggaatctgaaagaatgttcaccctggatgagcgacttcaaagtggagttcctgagaaatgagctggagattcccggtcagtatgacggtaggggaaagccattgccagagtaccacgtgcgaatcgccgggtttgatgagcgggtgacagtcatggcgtctctgcgaaggcccaagcgcatcatcatccgtggccatgacgagagggaacaccctttcctggtgaagggtggcgaggacctgcggcaggaccagcgcgtggagcagctcttccaggtcatgaatgggatcctggcccaagactccgcctgcagccagagggccctgcagctgaggacctatagcgttgtgcccatgacctccagtgatcccagggcaccgccgtgtgaatataaagattggctgacaaaaatgtcaggaaaacatgatgttggagcttacatgctaatgtataagggcgctaatcgtactgaaacagtcacgtcttttagaaaacgagaaagtaaagtgcctgctgatctcttaaagcgggccttcgtgaggatgagtacaagccctgaggctttcctggcgctccgctcccacttcgccagctctcacgctctgatatgcatcagccactggatcctcgggattggagacagacatctgaacaactttatggtggccatggagactggcggcgtgatcgggatcgactttgggcatgcgtttggatccgctacacagtttctgccagtccctgagttgatgccttttcggctaactcgccagtttatcaatctgatgttaccaatgaaagaaacgggccttatgtacagcatcatggtacacgcactccgggccttccgctcagaccctggcctgctcaccaacaccatggatgtgtttgtcaaggagccctcctttgattggaaaaattttgaacagaaaatgctgaaaaaaggagggtcatggattcaagaaataaatgttgctgaaaaaaattggtacccccgacagaaaatatgttacgctaagagaaagttagcaggtgccaatccagcagtcattacttgtgatgagctactcctgggtcatgagaaggcccctgccttcagagactatgtggctgtggcacgaggaagcaaagatcacaacattcgtgcccaagaaccagagagtgggctttcagaagagactcaagtgaagtgcctgatggaccaggcaacagaccccaacatccttggcagaacctgggaaggatgggagccctggatgtgaggtctgtgggagtctgcagatagaaagcattacattgtttaaagaatctactatactttggttggcagcattccatgagctgattttcctgaaacactaaagagaaatgtcttttgtgctacagtttcgtagcatgagtttaaatcaagattatgatgagtaaatgtgtatgggttaaatcaaagataaggttatagtaacatcaaagattaggtgaggtttatagaaagatagatatccaggcttaccaaagtattaagtcaagaatataatatgtgatcagctttcaaagcatttacaagtgctgcaagttagtgaaacagctgtctccgtaaatggaggaaatgtggggaagccttggaatgcccttctggttctggcacattggaaagcacactcagaaggcttcatcaccaagattttgggagagtaaagctaagtatagttgatgtaacattgtagaagcagcataggaacaataagaacaataggtaaagctataattatggcttatatttagaaatgactgcatttgatattttaggatatttttctaggttttttcctttcattttattctcttctagttttgacattttatgatagatttgctctctagaaggaaacgtctttatttaggagggcaaaaattttggtcatagcattcacttttgctattccaatctacaactggaagatacataaaagtgctttgcattgaatttgggataacttcaaaaatcccatggttgttgttagggatagtactaagcatttcagttccaggagaataaaagaaattcctatttgaaatgaattcctcatttggaggaaaaaaagcatgcattctagcacaacaagatgaaattatggaatacaaaagtggctccttcccatgtgcagtccctgtccccccccgccagtcctccacacccaaactgtttctgattggcttttagctttttgttgtttttttttttccttctaacacttgtatttggaggctcttctgtgattttgagaagtatactcttgagtgtttaataaagtttttttccaaaagta

SEQ ID NO: 416 - protein, 4097 aa, Homo sapiens
MAGSGAGVRCSLLRLQETLSAADRCGAALAGHQLIRGLGQECVLSSSPAVLALQTSLVFSRDFGLLVFVRKSLNSIEFRECREEILKFLCIFLEKMGQKIAPYSVEIKNTCTSVYTKDRAAKCKIPALDLLIKLLQTFRSSRLMDEFKIGELFSKFYGELALKKKIPDTVLEKVYELLGLLGEVHPSEMINNAENLFRAFLGELKTQMTSAVREPKLPVLAGCLKGLSSLLCNFTKSMEEDPQTSREIFNFVLKAIRPQIDLKRYAVPSAGLRLFALHASQFSTCLLDNYVSLFEVLLKWCAHTNVELKKAALSALESFLKQVSNMVAKNAEMHKNKLQYFMEQFYGIIRNVDSNNKELSIAIRGYGLFAGPCKVINAKDVDFMYVELIQRCKQMFLTQTDTGDDRVYQMPSFLQSVASVLLYLDTVPEVYTPVLEHLVVMQIDSFPQYSPKMQLVCCRAIVKVFLALAAKGPVLRNCISTVVHQGLIRICSKPVVLPKGPESESEDHRASGEVRTGKWKVPTYKDYVDLFRHLLSSDQMMDSILADEAFFSVNSSSESLNHLLYDEFVKSVLKIVEKLDLTLEIQTVGEQENGDEAPGVWMIPTSDPAANLHPAKPKDFSAFINLVEFCREILPEKQAEFFEPWVYSFSYELILQSTRLPLISGFYKLLSITVRNAKKIKYFEGVSPKSLKHSPEDPEKYSCFALFVKFGKEVAVKMKQYKDELLASCLTFLLSLPHNIIELDVRAYVPALQMAFKLGLSYTPLAEVGLNALEEWSIYIDRHVMQPYYKDILPCLDGYLKTSALSDETKNNWEVSALSRAAQKGFNKVVLKHLKKTKNLSSNEAISLEEIRIRVVQMLGSLGGQINKNLLTVTSSDEMMKSYVAWDREKRLSFAVPFREMKPVIFLDVFLPRVTELALTASDRQTKVAACELLHSMVMFMLGKATQMPEGGQGAPPMYQLYKRTFPVLLRLACDVDQVTRQLYEPLVMQLIHWFTNNKKFESQDTVALLEAILDGIVDPVDSTLRDFCGRCIREFLKWSIKQITPQQQEKSPVNTKSLFKRLYSLALHPNAFKRLGASLAFNNIYREFREEESLVEQFVFEALVIYMESLALAHADEKSLGTIQQCCDAIDHLCRIIEKKHVSLNKAKKRRLPRGFPPSASLCLLDLVKWLLAHCGRPQTECRHKSIELFYKFVPLLPGNRSPNLWLKDVLKEEGVSFLINTFEGGGCGQPSGILAQPTLLYLRGPFSLQATLCWLDLLLAALECYNTFIGERTVGALQVLGTEAQSSLLKAVAFFLESIAMHDIIAAEKCFGTGAAGNRTSPQEGERYNYSKCTVVVRIMEFTTTLLNTSPEGWKLLKKDLCNTHLMRVLVQTLCEPASIGFNIGDVQVMAHLPDVCVNLMKALKMSPYKDILETHLREKITAQSIEELCAVNLYGPDAQVDRSRLAAVVSACKQLHRAGLLHNILPSQSTDLHHSVGTELLSLVYKGIAPGDERQCLPSLDLSCKQLASGLLELAFAFGGLCERLVSLLLNPAVLSTASLGSSQGSVIHFSHGEYFYSLFSETINTELLKNLDLAVLELMQSSVDNTKMVSAVLNGMLDQSFRERANQKHQGLKLATTILQHWKKCDSWWAKDSPLETKMAVLALLAKILQIDSSVSFNTSHGSFPEVFTTYISLLADTKLDLHLKGQAVTLLPFFTSLTGGSLEELRRVLEQLIVAHFPMQSREFPPGTPRFNNYVDCMKKFLDALELSQSPMLLELMTEVLCREQQHVMEELFQSSFRRIARRGSCVTQVGLLESVYEMFRKDDPRLSFTRQSFVDRSLLTLLWHCSLDALREFFSTIVVDAIDVLKSRFTKLNESTFDTQITKKMGYYKILDVMYSRLPKDDVHAKESKINQVFHGSCITEGNELTKTLIKLCYDAFTENMAGENQLLERRRLYHCAAYNCAISVICCVFNELKFYQGFLFSEKPEKNLLIFENLIDLKRRYNFPVEVEVPMERKKKYIEIRKEAREAANGDSDGPSYMSSLSYLADSTLSEEMSQFDFSTGVQSYSYSSQDPRPATGRFRRREQRDPTVHDDVLELEMDELNRHECMAPLTALVKHMHRSLGPPQGEEDSVPRDLPSWMKFLHGKLGNPIVPLNIRLFLAKLVINTEEVFRPYAKHWLSPLLQLAASENNGGEGIHYMVVEIVATILSWTGLATPTGVPKDEVLANRLLNFLMKHVFHPKRAVFRHNLEIIKTLVECWKDCLSIPYRLIFEKFSGKDPNSKDNSVGIQLLGIVMANDLPPYDPQCGIQSSEYFQALVNNMSFVRYKEVYAAAAEVLGLILRYVMERKNILEESLCELVAKQLKQHQNTMEDKFIVCLNKVTKSFPPLADRFMNAVFFLLPKFHGVLKTLCLEVVLCRVEGMTELYFQLKSKDFVQVMRHRDDERQKVCLDIIYKMMPKLKPVELRELLNPVVEFVSHPSTTCREQMYNILMWIHDNYRDPESETDNDSQEIFKLAKDVLIQGLIDENPGLQLIIRNFWSHETRLPSNTLDRLLALNSLYSPKIEVHFLSLATNFLLEMTSMSPDYPNPMFEHPLSECEFQEYTIDSDWRFRSTVLTPMFVETQASQGTLQTRTQEGSLSARWPVAGQIRATQQQHDFTLTQTADGRSSFDWLTGSSTDPLVDHTSPSSDSLLFAHKRSERLQRAPLKSVGPDFGKKRLGLPGDEVDNKVKGAAGRTDLLRLRRRFMRDQEKLSLMYARKGVAEQKREKEIKSELKMKQDAQVVLYRSYRHGDLPDIQIKHSSLITPLQAVAQRDPIIAKQLFSSLFSGILKEMDKFKTLSEKNNITQKLLQDFNRFLNTTFSFFPPFVSCIQDISCQHAALLSLDPAAVSAGCLASLQQPVGIRLLEEALLRLLPAELPAKRVRGKARLPPDVLRWVELAKLYRSIGEYDVLRGIFTSEIGTKQITQSALLAEARSDYSEAAKQYDEALNKQDWVDGEPTEAEKDFWELASLDCYNHLAEWKSLEYCSTASIDSENPPDLNKIWSEPFYQETYLPYMIRSKLKLLLQGEADQSLLTFIDKAMHGELQKAILELHYSQELSLLYLLQDDVDRAKYYIQNGIQSFMQNYSSIDVLLHQSRLTKLQSVQALTEIQEFISFISKQGNLSSQVPLKRLLNTWTNRYPDAKMDPMNIWDDIITNRCFFLSKIEEKLTPLPEDNSMNVDQDGDPSDRMEVQEQEEDISSLIRSCKFSMKMKMIDSARKQNNFSLAMKLLKELHKESKTRDDWLVSWVQSYCRLSHCRSRSQGCSEQVLTVLKTVSLLDENNVSSYLSKNILAFRDQNILLGTTYRIIANALSSEPACLAEIEEDKARRILELSGSSSEDSEKVIAGLYQRAFQHLSEAVQAAEEEAQPPSWSCGPAAGVIDAYMTLADFCDQQLRKEEENASVIDSAELQAYPALVVEKMLKALKLNSNEARLKFPRLLQIIERYPEETLSLMTKEISSVPCWQFISWISHMVALLDKDQAVAVQHSVEEITDNYPQAIVYPFIISSESYSFKDTSTGHKNKEFVARIKSKLDQGGVIQDFINALDQLSNPELLFKDWSNDVRAELAKTPVNKKNIEKMYERMYAALGDPKAPGLGAFRRKFIQTFGKEFDKHFGKGGSKLLRMKLSDFNDITNMLLLKMNKDSKPPGNLKECSPWMSDFKVEFLRNELEIPGQYDGRGKPLPEYHVRIAGFDERVTVMASLRRPKRIIIRGHDEREHPFLVKGGEDLRQDQRVEQLFQVMNGILAQDSACSQRALQLRTYSVVPMTSSDPRAPPCEYKDWLTKMSGKHDVGAYMLMYKGANRTETVTSFRKRESKVPADLLKRAFVRMSTSPEAFLALRSHFASSHALICISHWILGIGDRHLNNFMVAMETGGVIGIDFGHAFGSATQFLPVPELMPFRLTRQFINLMLPMKETGLMYSIMVHALRAFRSDPGLLTNTMDVFVKEPSFDWKNFEQKMLKKGGSWIQEINVAEKNWYPRQKICYAKRKLAGANPAVITCDELLLGHEKAPAFRDYVAVARGSKDHNIRAQEPESGLSEETQVKCLMDQATDPNILGRTWEGWEPWM

SEQ ID NO: 417 - DNA, 1308 bp, Homo sapiens
gtcagccgctgtccccttagccgcgatgccgctggagaacctggaggaggagggtctgcccaagaaccccgacttgcgtatcgcgcagctgcgcttcctgctcagcctgcccgagcaccgcggagacgctgccgtgcgcgacgagctgatggcggccgtccgcgataacaacatggctccttactatgaagccttgtgcaaatccctcgactggcagatagacgtggacctactcaataaaatgaagaaggcaaatgaagatgagttgaagcgtttggatgaggagctggaagatgcagagaagaatctaggagagagcgaaattcgcgatgcaatgatggcaaaggccgagtacctctgccggataggtgacaaagagggagctctgacagcctttcgcaagacatatgacaaaactgtggccctgggtcaccgattggatattgtattctatctccttaggattggcttattttatatggataatgatctcatcacacgaaacacagaaaaggccaaaagcttaatagaagaaggaggagactgggacaggagaaaccgcctaaaagtgtatcagggtctttattgtgtggctattcgtgatttcaaacaggcagctgaactcttccttgacactgtttcaacatttacatcctatgaactcatggattataaaacatttgtgacttatactgtctatgtcagtatgattgccttagaaagaccagatctcagggaaaaggtcattaaaggagcagagattcttgaagtgttgcacagtcttccagcagttcggcagtatctgttttcactctatgaatgccgttactctgttttcttccaatcattagcggttgtggaacaggaaatgaaaaaggactggctttttgcccctcattatcgatactatgtaagagaaatgagaattcatgcatacagtcagctgctggaatcatataggtcattaacccttggctatatggcagaagcgtttggtgttggtgtggaattcattgatcaggaactgtccaggtttattgctgccgggagactacactgcaaaatagataaagtgaatgaaatagtagaaaccaacagacctgatagcaagaactggcagtaccaagaaactatcaagaaaggagatctgctactaaacagagttcaaaaactttccagagtaattaatatgtaaagccatgtaactaacaaaggatttgctttagagataattatttggaatttttatagcttacttcacaatgtgcccaggtcagctgtataaaataaatactgcattgttgtttc

SEQ ID NO: 418 - protein, 389 aa, Homo sapiens
MPLENLEEEGLPKNPDLRIAQLRFLLSLPEHRGDAAVRDELMAAVRDNNMAPYYEALCKSLDWQIDVDLLNKMKKANEDELKRLDEELEDAEKNLGESEIRDAMMAKAEYLCRIGDKEGALTAFRKTYDKTVALGHRLDIVFYLLRIGLFYMDNDLITRNTEKAKSLIEEGGDWDRRNRLKVYQGLYCVAIRDFKQAAELFLDTVSTFTSYELMDYKTFVTYTVYVSMIALERPDLREKVIKGAEILEVLHSLPAVRQYLFSLYECRYSVFFQSLAVVEQEMKKDWLFAPHYRYYVREMRIHAYSQLLESYRSLTLGYMAEAFGVGVEFIDQELSRFIAAGRLHCKIDKVNEIVETNRPDSKNWQYQETIKKGDLLLNRVQKLSRVINM

SEQ ID NO: 419 - DNA, 3879 bp, Homo sapiens; identical to SEQ ID NO: 35

SEQ ID NO: 420 - protein, 798 aa, Homo sapiens; identical to SEQ ID NO: 36

SEQ ID NO: 421 - DNA, 7778 bp, Homo sapiens
agcagtgctaaaggagcccggcggaggcagcggtgggtttgggactgaggcgctggatctgtggtcgcggctggggacgtgcgcccgcgccaccatcttcggctgaagaggcaattgcttttggatcgttccatttacaatggcgcagagaactggactcgaggatccagagaggtatctctttgtggacagggctgtcatctacaaccctgccactcaagctgattggacagctaaaaagctagtgtggattccatcagaacgccatggttttgaggcagctagtatcaaagaagaacggggagatgaagttatggtggagttggcagagaatggaaagaaagcaatggtcaacaaagatgatattcagaagatgaacccacctaagttttccaaggtggaggatatggcagaattgacatgcttgaatgaagcttccgttttacataatctgaaggatcgctactattcaggactaatctatacttattctggactcttctgtgtagttataaacccttacaagaatcttccaatttactctgagaatattattgaaatgtacagagggaagaagcgtcatgagatgcctccacacatctatgctatatctgaatctgcttacagatgcatgcttcaagatcgtgaggaccagtcaattctttgcacgggtgagtcaggtgctgggaagacagaaaatacaaagaaagttattcagtaccttgcccatgttgcttcttcacataaaggaagaaaggaccataatattcctcaggaatcgcctaaaccagtgaaacaccagggggaacttgaacggcagcttttgcaagcaaatccaattctggaatcatttggaaatgcgaagactgtgaaaaatgataactcatctcgttttggcaaatttattcggatcaactttgatgtaactggctatatcgttggggccaacattgaaacataccttctggaaaagtctcgtgctgttcgtcaagcaaaagatgaacgtacttttcatatcttttaccagttgttatctggagcaggagaacacctaaagtctgatttgcttcttgaaggatttaataactacaggtttctctccaatggctatattcctattccgggacagcaagacaaagataatttccaggagaccatggaagcaatgcacataatgggcttctcccatgaagagattctgtcaatgcttaaagtagtatcttcagtgctacagtttggaaatatttctttcaaaaaggagagaaatactgatcaagcttccatgccagaaaatacagttgcgcagaagctctgccatcttcttgggatgaatgtgatggagtttactcgggccatcctgactccccggatcaaggtcggccgagactatgtgcaaaaagcccagaccaaagaacaggcagattttgcagtagaagcattggcaaaagctacctatgagcggctctttcgctggctcgttcatcgcatcaataaagctctggataggaccaaacgtcagggagcatctttcattggaatcctggatattgctggatttgaaatttttgagctgaactcctttgaacaactttgcatcaactacaccaatgagaagctgcagcagctgttcaaccacaccatgtttatcctagaacaagaggaataccagcgcgaaggcatcgagtggaacttcatcgatttcgggctggatctgcagccatgcatcgacctaatagagagacctgcgaaccctcctggtgtactggcccttttggatgaagaatgctggttccctaaagccacagataaaacctttgttgaaaaactggttcaagagcaaggttcccactccaagtttcagaaacctcgacaattaaaagacaaagctgatttttgcattatacattatgcagggaaggtggactataaggcagatgagtggctgatgaagaatatggaccccctgaatgacaacgtggccacccttttgcaccagtcatcagacagatttgtggcagagctttggaaagatgagattcagaatattcagagagcttctttctatgacagtgtttctggtcttcatgagccaccagtggaccgtatcgtgggtctggatcaagtcactggtatgactgagacagcttttggctccgcatataaaaccaagaagggcatgtttcgtaccgttgggcaactctacaaagaatctctcaccaagctgatggcaactctccgaaacaccaaccctaactttgttcgttgtatcattccaaatcacgagaagagggctggaaaattggatccacacctagtcctagatcagcttcgctgtaatggtgtcctggaagggatccgaatctgtcgccagggcttccctaaccgaatagttttccaggaattcagacagagatatgagatcctaactccaaatgctattcctaaaggttttatggatggtaaacaggcctgtgaacgaatgatccgggctttagaattggacccaaacttgtacagaattggacagagcaagatatttttcagagctggagttctggcacacttagaggaagaaagagatttaaaaatcaccgatatcattatcttcttccaggccgtttgcagaggttacctggccagaaaggcctttgccaagaagcagcagcaactaagtgccttaaaggtcttgcagcggaactgtgccgcgtacctgaaattacggcactggcagtggtggcgagtcttcacaaaggtgaagccgcttctacaagtgactcgccaggaggaagaacttcaggccaaagatgaagagctgttgaaggtgaaggagaagcagacgaaggtggaaggagagctggaggagatggagcggaagcaccagcagcttttagaagagaagaatatccttgcagaacaactacaagcagagactgagctctttgctgaagcagaagagatgagggcaagacttgctgctaaaaagcaggaattagaagagattctacatgacttggagtctagggttgaagaagaagaagaaagaaaccaaatcctccaaaatgaaaagaaaaaaatgcaagcacatattcaggacctggaagaacagctagacgaggaggaaggggctcggcaaaagctgcagctggaaaaggtgacagcagaggccaagatcaagaagatggaagaggagattctgcttctcgaggaccaaaattccaagttcatcaaagaaaagaaactcatggaagatcgcattgctgagtgttcctctcagctggctgaagaggaagaaaaggcgaaaaacttggccaaaatcaggaataagcaagaagtgatgatctcagatttagaagaacgcttaaagaaggaagaaaagactcgtcaggaactggaaaaggccaaaagaaaactcgacggggagacgaccgacctgcaggaccagatcgcagagctgcaggcgcagattgatgagctcaagctgcagctggccaagaaggaggaggagctgcagggcgcactggccagaggtgatgatgaaacactccataagaacaatgcccttaaagttgtgcgagagctacaagcccaaattgctgaacttcaggaagactttgaatccgagaaggcttcacggaacaaggccgaaaagcagaaaagggacttgagtgaggaactggaagctctgaaaacagagctggaggacacgctggacaccacggcagcccagcaggaactacgtacaaaacgtgaacaagaagtggcagagctgaagaaagctcttgaggaggaaactaagaaccatgaagctcaaatccaggacatgagacaaagacacgcaacagccctggaggagctctcagagcagctggaacaggccaagcggttcaaagcaaatctagagaagaacaagcagggcctggagacagataacaaggagctggcgtgtgaggtgaaggtcctgcagcaggtcaaggctgagtctgagcacaagaggaagaagctcgacgcgcaggtccaggagctccatgccaaggtctctgaaggcgacaggctcagggtggagctggcggagaaagcaagtaagctgcagaatgagctagataatgtctccacccttctggaagaagcagagaagaagggtattaaatttgctaaggatgcagctagtcttgagtctcaactacaggatacacaggagcttcttcaggaggagacacgccagaaactaaacctgagcagtcggatccggcagctggaagaggagaagaacagtcttcaggagcagcaggaggaggaggaggaggccaggaagaacctggagaagcaagtgctggccctgcagtcccagttggctgataccaagaagaaagtagatgacgacctgggaacaattgaaagtctggaagaagccaagaagaagcttctgaaggacgcggaggccctgagccagcgcctggaggagaaggcactggcgtatgacaaactggagaagaccaagaaccgcctgcagcaggagctggacgacctcacggtggacctggaccaccagcgccaggtcgcctccaacttggagaagaagcagaagaagtttgaccagctgttagcagaagagaagagcatctctgctcgctatgccgaagagcgggaccgggccgaagccgaggccagagagaaagaaaccaaagccctgtcactggcccgggccctcgaggaagccctggaggccaaggaggagtttgagaggcagaacaagcagctccgagcagacatggaagacctcatgagctccaaagatgatgtgggaaaaaacgttcacgaacttgaaaaatccaaacgggccctagagcagcaggtggaggaaatgaggacccagctggaggagctggaagacgaactccaggccacggaagatgccaagcttcgtctggaggtcaacatgcaggccatgaaggcgcagttcgagagagacctgcaaaccagggatgagcagaatgaagagaagaagcggctgctgatcaaacaggtgcgggagctcgaggcggagctggaggatgagaggaaacagcgggcgcttgctgtagcttcaaagaaaaagatggagatagacctgaaggacctcgaagcccaaatcgaggctgcgaacaaagctcgggatgaggtgattaagcagctccgcaagctccaggctcagatgaaggattaccaacgtgaattagaagaagctcgtgcatccagagatgagatttttgctcaatccaaagagagtgaaaagaaattgaagagtctggaagcagaaatccttcaattgcaggaggaacttgcctcatctgagcgagcccgccgacacgccgagcaggagagagatgagctggcggacgagatcaccaacagcgcctctggcaagtccgcgctgctggatgagaagcggcgtctggaagctcggatcgcacagctggaggaggagctggaagaggagcagagcaacatggagctgctcaacgaccgcttccgcaagaccactctacaggtggacacactgaacgccgagctagcagccgagcgcagcgccgcccagaagagtgacaatgcacgccagcaactggagcggcagaacaaggagctgaaggccaagctgcaggaactcgagggtgctgtcaagtctaagttcaaggccaccatctcagccctggaggccaagattgggcagctggaggagcagcttgagcaggaagccaaggaacgagcagccgccaacaaattagtccgtcgcactgagaagaagctgaaagaaatcttcatgcaggttgaggatgagcgtcgacacgcggaccagtataaagagcagatggagaaggccaacgctcggatgaagcagcttaaacgccagctggaggaagcagaagaagaagcgacgcgtgccaacgcatctcggcgtaaactccagcgggaactggatgatgccaccgaggccaacgagggcctgagccgcgaggtcagcaccctgaagaaccggctgaggcggggtggccccatcagcttctcttccagccgatctggccggcgccagctgcaccttgaaggagcttccctggagctctccgacgatgacacagaaagtaagaccagtgatgtcaacgagacgcagccaccccagtcagagtaaagttgcaggaagccagaggaggcaatacagtgggacagttaggaatgcacccggggcctcctgcagatttcggaaattggcaagctacgggattccttcctgaaagatcaactgtgtcttaaggctctccagcctatgcatactgtatcctgcttcagacttaggtacaattgctcccctttttatatatagacacacacaggacacatatattaaacagattgtttcatcattgcatctattttccatatagtcatcaagagaccattttataaaacatggtaagaccctttttaaaacaaactccaggcccttggttgcgggtcgctgggttattggggcagcgccgtggtcgtcactcagtcgctctgcatgctctctgtcatacagacaggtaacctagttctgtgttcacgtggcccccgactcctcagccacatcaagtctcctagaccactgtggactctaaactgcacttgtctctctcatttccttcaaataatgatcaatgctatttcagtgagcaaactgtgaaaggggctttggaaagagtaggaggggtgggctggatcggaagcaacacccatttggggttaccatgtccatcccccaaggggggccctgcccctcgagtcgatggtgtcccgcatctactcatgtgaactggccttggcgagggctggtctgtgcatagaagggatagtggccacactgcagctgaggccccaggtggcagccatggatcatgtagacttccagatggtctcccgaaccgcctggctctgccggcgccctcctcacgtcaggagcaagcagccgtggacccctaagccgagctggtggaaggcccctccccgtcgccagccgggccctcatgctgaccttgcaaattcagccgctgctttgagcccaaaatgggaatattggttttgtgtccgaggcttgttccaagtttgtcaatgaggtttatggagcctccagaacagatgccatcttcctgaatgttgacatgccagtgggtgtgactccttcatttttccttctcccttccctttggacagtgttacagtgaacacttagcatcctgtttttggttggtagttaagcaaactgacattacggaaagtgccttagacactacagtactaagacaatgttgaatatatcattcgcctctataacaatttaatgtattcagttttgactgtgcttcatatcatgtacctctctagtcaaagtggtattacagacattcagtgacaatgaatcagtgttaattctaaatccttgatcctctgcaatgtgcttgaaaacacaaaccttttgggttaaaagctttaacatctattaggaagaatttgtcctgtgggtttggaatcttggattttccccctttatgaactgtactggctgttgaccaccagacacctgaccgcaaatatcttttcttgtattcccatatttctagacaatgatttttgtaagacaataaatttattcattatagatatttgcgcctgctctgtttacttgaagaaaaaagcacccgtggagaataaagagacctcaataaacaagaataatcatgtgaacgtggaaaaaaaaaaaaaaaaaa

SEQ ID NO: 422 - protein, 2007 aa, Homo sapiens
MAQRTGLEDPERYLFVDRAVIYNPATQADWTAKKLVWIPSERHGFEAASIKEERGDEVMVELAENGKKAMVNKDDIQKMNPPKFSKVEDMAELTCLNEASVLHNLKDRYYSGLIYTYSGLFCVVINPYKNLPIYSENIIEMYRGKKRHEMPPHIYAISESAYRCMLQDREDQSILCTGESGAGKTENTKKVIQYLAHVASSHKGRKDHNIPQESPKPVKHQGELERQLLQANPILESFGNAKTVKNDNSSRFGKFIRINFDVTGYIVGANIETYLLEKSRAVRQAKDERTFHIFYQLLSGAGEHLKSDLLLEGFNNYRFLSNGYIPIPGQQDKDNFQETMEAMHIMGFSHEEILSMLKVVSSVLQFGNISFKKERNTDQASMPENTVAQKLCHLLGMNVMEFTRAILTPRIKVGRDYVQKAQTKEQADFAVEALAKATYERLFRWLVHRINKALDRTKRQGASFIGILDIAGFEIFELNSFEQLCINYTNEKLQQLFNHTMFILEQEEYQREGIEWNFIDFGLDLQPCIDLIERPANPPGVLALLDEECWFPKATDKTFVEKLVQEQGSHSKFQKPRQLKDKADFCIIHYAGKVDYKADEWLMKNMDPLNDNVATLLHQSSDRFVAELWKDEIQNIQRASFYDSVSGLHEPPVDRIVGLDQVTGMTETAFGSAYKTKKGMFRTVGQLYKESLTKLMATLRNTNPNFVRCIIPNHEKRAGKLDPHLVLDQLRCNGVLEGIRICRQGFPNRIVFQEFRQRYEILTPNAIPKGFMDGKQACERMIRALELDPNLYRIGQSKIFFRAGVLAHLEEERDLKITDIIIFFQAVCRGYLARKAFAKKQQQLSALKVLQRNCAAYLKLRHWQWWRVFTKVKPLLQVTRQEEELQAKDEELLKVKEKQTKVEGELEEMERKHQQLLEEKNILAEQLQAETELFAEAEEMRARLAAKKQELEEILHDLESRVEEEEERNQILQNEKKKMQAHIQDLEEQLDEEEGARQKLQLEKVTAEAKIKKMEEEILLLEDQNSKFIKEKKLMEDRIAECSSQLAEEEEKAKNLAKIRNKQEVMISDLEERLKKEEKTRQELEKAKRKLDGETTDLQDQIAELQAQIDELKLQLAKKEEELQGALARGDDETLHKNNALKVVRELQAQIAELQEDFESEKASRNKAEKQKRDLSEELEALKTELEDTLDTTAAQQELRTKREQEVAELKKALEEETKNHEAQIQDMRQRHATALEELSEQLEQAKRFKANLEKNKQGLETDNKELACEVKVLQQVKAESEHKRKKLDAQVQELHAKVSEGDRLRVELAEKASKLQNELDNVSTLLEEAEKKGIKFAKDAASLESQLQDTQELLQEETRQKLNLSSRIRQLEEEKNSLQEQQEEEEEARKNLEKQVLALQSQLADTKKKVDDDLGTIESLEEAKKKLLKDAEALSQRLEEKALAYDKLEKTKNRLQQELDDLTVDLDHQRQVASNLEKKQKKFDQLLAEEKSISARYAEERDRAEAEAREKETKALSLARALEEALEAKEEFERQNKQLRADMEDLMSSKDDVGKNVHELEKSKRALEQQVEEMRTQLEELEDELQATEDAKLRLEVNMQAMKAQFERDLQTRDEQNEEKKRLLIKQVRELEAELEDERKQRALAVASKKKMEIDLKDLEAQIEAANKARDEVIKQLRKLQAQMKDYQRELEEARASRDEIFAQSKESEKKLKSLEAEILQLQEELASSERARRHAEQERDELADEITNSASGKSALLDEKRRLEARIAQLEEELEEEQSNMELLNDRFRKTTLQVDTLNAELAAERSAAQKSDNARQQLERQNKELKAKLQELEGAVKSKFKATISALEAKIGQLEEQLEQEAKERAAANKLVRRTEKKLKEIFMQVEDERRHADQYKEQMEKANARMKQLKRQLEEAEEEATRANASRRKLQRELDDATEANEGLSREVSTLKNRLRRGGPISFSSSRSGRRQLHLEGASLELSDDDTESKTSDVNETQPPQSE

SEQ ID NO: 423 - DNA, 2732 bp, Homo sapiens
ctttcgcctcagtctcgagctctcgctggccttcgggtgtacgtgctccgggatcttcagcacccgcggccgccatcgccgtcgcttggcttcttctggactcatctgcgccacttgtccgcttcacactccgccgccatcatggtgaagctcgcgaaggcaggtaaaaatcaaggtgaccccaagaaaatggctcctcctccaaaggaggtagaagaagatagtgaagatgaggaaatgtcagaagatgaagaagatgatagcagtggagaagaggtcgtcatacctcagaagaaaggcaagaaggctgctgcaacctcagcaaagaaggtggtcgtttccccaacaaaaaaggttgcagttgccacaccagccaagaaagcagctgtcactccaggcaaaaaggcagcagcaacacctgccaagaagacagttacaccagccaaagcagttaccacacctggcaagaagggagccacaccaggcaaagcattggtagcaactcctggtaagaagggtgctgccatcccagccaagggggcaaagaatggcaagaatgccaagaaggaagacagtgatgaagaggaggatgatgacagtgaggaggatgaggaggatgacgaggacgaggatgaggatgaagatgaaattgaaccagcagcgatgaaagcagcagctgctgcccctgcctcagaggatgaggacgatgaggatgacgaagatgatgaggatgacgatgacgatgaggaagatgactctgaagaagaagctatggagactacaccagccaaaggaaagaaagctgcaaaagttgttcctgtgaaagccaagaacgtggctgaggatgaagatgaagaagaggatgatgaggacgaggatgacgacgacgacgaagatgatgaagatgatgatgatgaagatgatgaggaggaggaagaagaggaggaggaagagcctgtcaaagaagcacctggaaaacgaaagaaggaaatggccaaacagaaagcagctcctgaagccaagaaacagaaagtggaaggcacagaaccgactacggctttcaatctctttgttggaaacctaaactttaacaaatctgctcctgaattaaaaactggtatcagcgatgtttttgctaaaaatgatcttgctgttgtggatgtcagaattggtatgactaggaaatttggttatgtggattttgaatctgctgaagacctggagaaagcgttggaactcactggtttgaaagtctttggcaatgaaattaaactagagaaaccaaaaggaaaagacagtaagaaagagcgagatgcgagaacacttttggctaaaaatctcccttacaaagtcactcaggatgaattgaaagaagtgtttgaagatgctgcggagatcagattagtcagcaaggatgggaaaagtaaagggattgcttatattgaatttaagacagaagctgatgcagagaaaacctttgaagaaaagcagggaacagagatcgatgggcgatctatttccctgtactatactggagagaaaggtcaaaatcaagactatagaggtggaaagaatagcacttggagtggtgaatcaaaaactctggttttaagcaacctctcctacagtgcaacagaagaaactcttcaggaagtatttgagaaagcaacttttatcaaagtaccccagaaccaaaatggcaaatctaaagggtatgcatttatagagtttgcttcattcgaagacgctaaagaagctttaaattcctgtaataaaagggaaattgagggcagagcaatcaggctggagttgcaaggacccaggggatcacctaatgccagaagccagccatccaaaactctgtttgtcaaaggcctgtctgaggataccactgaagagacattaaaggagtcatttgacggctccgttcgggcaaggatagttactgaccgggaaactgggtcctccaaagggtttggttttgtagacttcaacagtgaggaggatgccaaagctgccaaggaggccatggaagacggtgaaattgatggaaataaagttaccttggactgggccaaacctaagggtgaaggtggcttcgggggtcgtggtggaggcagaggcggctttggaggacgaggtggtggtagaggaggccgaggaggatttggtggcagaggccggggaggctttggagggcgaggaggcttccgaggaggcagaggaggaggaggtgaccacaagccacaaggaaagaagacgaagtttgaatagcttctgtccctctgctttcccttttccatttgaaagaaaggactctggggtttttactgttacctgatcaatgacagagccttctgaggacattccaagacagtatacagtcctgtggtctccttggaaatccgtctagttaacatttcaagggcaataccgtgttggttttgactggatattcatataaactttttaaagagttgagtgatagagctaacccttatctgtaagttttgaatttatattgtttcatcccatgtacaaaaccattttttcctacaaatagtttgggttttgttgttgtttcttttttttgttttgtttttgttttttttttttttgcgttcgtggggttgtaaaagaaaagaaagcagaatgttttatcatggtttttgcttcagcggctttaggacaaattaaaagtcaactctggtgccagaaaaaaaaaaaaaaaa

SEQ ID NO: 424 - protein, 710 aa, Homo sapiens
MVKLAKAGKNQGDPKKMAPPPKEVEEDSEDEEMSEDEEDDSSGEEVVIPQKKGKKAAATSAKKVVVSPTKKVAVATPAKKAAVTPGKKAAATPAKKTVTPAKAVTTPGKKGATPGKALVATPGKKGAAIPAKGAKNGKNAKKEDSDEEEDDDSEEDEEDDEDEDEDEDEIEPAAMKAAAAAPASEDEDDEDDEDDEDDDDDEEDDSEEEAMETTPAKGKKAAKVVPVKAKNVAEDEDEEEDDEDEDDDDDEDDEDDDDEDDEEEEEEEEEEPVKEAPGKRKKEMAKQKAAPEAKKQKVEGTEPTTAFNLFVGNLNFNKSAPELKTGISDVFAKNDLAVVDVRIGMTRKFGYVDFESAEDLEKALELTGLKVFGNEIKLEKPKGKDSKKERDARTLLAKNLPYKVTQDELKEVFEDAAEIRLVSKDGKSKGIAYIEFKTEADAEKTFEEKQGTEIDGRSISLYYTGEKGQNQDYRGGKNSTWSGESKTLVLSNLSYSATEETLQEVFEKATFIKVPQNQNGKSKGYAFIEFASFEDAKEALNSCNKREIEGRAIRLELQGPRGSPNARSQPSKTLFVKGLSEDTTEETLKESFDGSVRARIVTDRETGSSKGFGFVDFNSEEDAKAAKEAMEDGEIDGNKVTLDWAKPKGEGGFGGRGGGRGGFGGRGGGRGGRGGFGGRGRGGFGGRGGFRGGRGGGGDHKPQGKKTKFE

SEQ ID NO: 425 - DNA, 3656 bp, Homo sapiens
agcgatccgaggcccggccccggccccgccccgcgccgcgccgcgccgcttgccgccgggctagcactgacgtgtctctcggcggagctgctgtgcagtggaacgcgctgggccgcgggcagcgtcgcctcacgcggagcagagctgagctgaagcgggacccggagcccgagcagccgccgccatggcaatcaaatttctggaagtcatcaagcccttctgtgtcatcctgccggaaattcagaagccagagaggaagattcagtttaaggagaaagtgctgtggaccgctatcaccctctttatcttcttagtgtgctgccagattcccctgtttgggatcatgtcttcagattcagctgaccctttctattggatgagagtgattctagcctctaacagaggcacattgatggagctagggatctctcctattgtcacgtctggccttataatgcaactcttggctggcgccaagataattgaagttggtgacaccccaaaagaccgagctctcttcaacggagcccaaaagttatttggcatgatcattactatcggccagtctatcgtgtatgtgatgaccgggatgtatggggacccttctgaaatgggtgctggaatttgcctgctaatcaccattcagctctttgttgctggcttaattgtcctacttttggatgaactcctgcaaaaaggatatggccttggctctggtatttctctcttcattgcaactaacatctgtgaaaccatcgtatggaaggcattcagccccactactgtcaacactggccgaggaatggaatttgaaggtgctatcatcgcacttttccatctgctggccacacgcacagacaaggtccgagcccttcgggaggcgttctaccgccagaatcttcccaacctcatgaatctcatcgccaccatctttgtctttgcagtggtcatctatttccagggcttccgagtggacctgccaatcaagtcggcccgctaccgtggccagtacaacacctatcccatcaagctcttctatacgtccaacatccccatcatcctgcagtctgccctggtgtccaacctttatgtcatctcccaaatgctctcagctcgcttcagtggcaacttgctggtcagcctgctgggcacctggtcggacacgtcttctgggggcccagcacgtgcttatccagttggtggcctttgctattacctgtcccctccagaatcttttggctccgtgttagaagacccggtccatgcagttgtatacatagtgttcatgctgggctcctgtgcattcttctccaaaacgtggattgaggtctcaggttcctctgccaaagatgttgcaaagcagctgaaggagcagcagatggtgatgagaggccaccgagagacctccatggtccatgaactcaaccggtacatccccacagccgcggcctttggtgggctgtgcatcggggccctctcggtcctggctgacttcctaggcgccattgggtctggaaccgggatcctgctcgcagtcacaatcatctaccagtactttgagatcttcgttaaggagcaaagcgaggttggcagcatgggggccctgctcttctgagcccgtctcccggacaggttgaggaagctgctccagaagcgcctcggaaggggagctctcatcatggcgcgtgctgctgcggcatatggacttttaataatgtttttgaatttcgtattctttcattccactgtgtaaagtgctagacattttccaatttaaaattttgctttttatcctggcactggcaaaaagaactgtgaaagtgaaattttattcagccgactgccagagaagtgggaatggtataggattgtccccaagtgtccatgtaacttttgttttaacctttgcaccttctcagtgctgtatgcggctgcagccgtctcacctgtttccccacaaagggaatttctcactctggttggaagcacaaacactgaaatgtctacgtttcattttggcagtagggtgtgaagctgggagcagatcatgtatttcccggagacgtgggaccttgctggcatgtctccttcacaatcaggcgtgggaatatctggcttaggactgtttctctctaagacaccattgttttcccttattttaaaagtgatttttttaaggacagaacttcttccaaaagagagggatggctttcccagaagacactcctggccatctgtggatttgtctgtgcacctattggctcttctagctgactcttctggttgggcttagagtctgcctgtttctgctagctccgtgtttagtccacttgggtcatcagctctgccaagctgagcctggccaagctaggtggacagacccttgcagtgatgtccgtttgtccagattctgccagtcatcactggacacgtctcctcgcagctgccctagcaaggggagacattgtggtagctatcagacatggacagaaactgacttagtgctcacaagcccctacaccttctgggctgaagatcacccagctgtgttcagaattttcttactgtgcttaggactgcacgcaagtgagcagacaccaccgacttcctttctgcgtcaccagtgtcgtcagcagagagaggacagcacaggctcaaggttggtagtgaagtcaggttcggggtgcatgggctgtggtggtgttgatcagttgctccagtgtttgaaataagaagactcatgtttatgtctggaataagttctgtttgtgctgacaggtggcctaggtcctggagatgagcaccctctctctggcctttagggagtcccctcttaggacaggcactgcccagcagcaagggcagcagagttgggtgctaagatcctgaggagctcgaggtttcgagctggctttagacattggtgggaccaaggatgttttgcaggatgccctgatcctaagaagggggcctgggggtgcgtgcagcctgtcggggagaccccactctgacagtgggcacacggcagcctgcaaagcacagggccaccgccacagcccggcagaggggcacactctggagaccttgctggcagtgctagccaggaaacagagtgaccaagggacaagaagggacttgcctaaagccacccagcaactcagcagcagaaccaagatgggccccaggctcctccatatggcccagggcttaccaccctatcacacgtggccttgtctagacccagtcctgagcaggggagaggctcttgagacctgatgccctcctacccacatggttctcccactgccctgtctgctctgctgctacagaggggcagggcctcccccagcccacgcttaggaatgcttggcctctggcaggcaggcagctgtacccaagctggtgggcagggggctggaaggcaccaggcctcaggaggagccccatagtcccgcctgcagcctgtaaccatcggctgggccctgcaaggcccacactcacgccctgtgggtgatggtcacggtgggtgggtgggggctgaccccagcttccaggggactgtcactgtggacgccaaaatggcataactgagataaggtgaataagtgacaaataaagccagttttttacaaggtaaaaaaaaaaaaaaaaaaaaa

SEQ ID NO: 426 - protein, 476 aa, Homo sapiens
MAIKFLEVIKPFCVILPEIQKPERKIQFKEKVLWTAITLFIFLVCCQIPLFGIMSSDSADPFYWMRVILASNRGTLMELGISPIVTSGLIMQLLAGAKIIEVGDTPKDRALFNGAQKLFGMIITIGQSIVYVMTGMYGDPSEMGAGICLLITIQLFVAGLIVLLLDELLQKGYGLGSGISLFIATNICETIVWKAFSPTTVNTGRGMEFEGAIIALFHLLATRTDKVRALREAFYRQNLPNLMNLIATIFVFAVVIYFQGFRVDLPIKSARYRGQYNTYPIKLFYTSNIPIILQSALVSNLYVISQMLSARFSGNLLVSLLGTWSDTSSGGPARAYPVGGLCYYLSPPESFGSVLEDPVHAVVYIVFMLGSCAFFSKTWIEVSGSSAKDVAKQLKEQQMVMRGHRETSMVHELNRYIPTAAAFGGLCIGALSVLADFLGAIGSGTGILLAVTIIYQYFEIFVKEQSEVGSMGALLF

SEQ ID NO: 427 - DNA, 3874 bp, Homo sapiens
ctaggcggcggcggccgggtccccaaggctgggcgctgcttgcggaaccgacggggcggagaggagcgtggcgggaggaggagtaggagaagggggctggtcaagggaagtgcgacgtgtctgcggagcctttttatacctccttcccgggagtccggcagccgctgctgctgctgctgctgctgctgccgccgccgccgccgccgtccctgcgtccttcggtctctgctcccgggacccgggctccgccgcagccagccagcatgtcggggatcaagaagcaaaagacggagaaccagcagaaatccaccaatgtagtctatcaggcccaccatgtgagcaggaataagagagggcaagtggttggaacaaggggtgggttccgaggatgtaccgtgtggctaacaggtctctctggtgctggaaaaacaacgataagttttgccctggaggagtaccttgtctcccatgccatcccttgttactccctggatggggacaatgtccgtcatggccttaacagaaatctcggattctctcctggggacagagaggaaaatatccgccggattgctgaggtggctaagctgtttgctgatgctggtctggtctgcattaccagctttatttctccattcgcaaaggatcgtgagaatgcccgcaaaatacatgaatcagcagggctgccattctttgaaatatttgtagatgcacctctaaatatttgtgaaagcagagacgtaaaaggcctctataaaagggccagagctggggagattaaaggatttacaggtattgattctgattatgagaaacctgaaactcctgagcgtgtgcttaaaaccaatttgtccacagtgagtgactgtgtccaccaggtagtggaacttctgcaagagcagaacattgtaccctatactataatcaaagatatccacgaactctttgtgccggaaaacaaacttgaccacgtccgagctgaggctgaaactctcccttcattatcaattactaagctggatctccagtgggtccaggttttgagcgaaggctgggccactcccctcaaaggtttcatgcgggagaaggagtacttacaggttatgcactttgacaccctgctagatggcatggcccttcctgatggcgtgatcaacatgagcatccccattgtactgcccgtctctgcagaggataagacacggctggaagggtgcagcaagtttgtcctggcacatggtggacggagggtagctatcttacgagacgctgaattctatgaacacagaaaagaggaacgctgttcccgtgtttgggggacaacatgtacaaaacacccccatatcaaaatggtgatggaaagtggggactggctggttggtggagaccttcaggtgctggagaaaataagatggaatgatgggctggaccaataccgtctgacacctctggagctcaaacagaaatgtaaagaaatgaatgctgatgcggtgtttgcattccagttgcgcaatcctgtccacaatggccatgccctgttgatgcaggacactcgccgcaggctcctagagaggggctacaagcacccggtcctcctactacaccctctgggcggctggaccaaggatgacgatgtgcctctagactggcggatgaagcagcacgcggctgtgctcgaggaaggggtcctggatcccaagtcaaccattgttgccatctttccgtctcccatgttatatgctggccccacagaggtccagtggcactgcaggtcccggatgattgcgggtgccaatttctacattgtggggagggaccctgcaggaatgccccatcctgaaaccaagaaggatctgtatgaacccactcatgggggcaaggtcttgagcatggcccctggcctcacctctgtggaaatcattccattccgagtggctgcctacaacaaagccaaaaaagccatggacttctatgatccagcaaggcacaatgagtttgacttcatctcaggaactcgaatgaggaagctcgcccgggaaggagagaatcccccagatggcttcatggcccccaaagcatggaaggtcctgacagattattacaggtccctggagaagaactaagcctttggctccagagtttctttctgaagtgctctttgattaccttttctatttttatgattagatgctttgtattaaattgcttctcaatgatgcattttaatcttttataatgaagtaaaagttgtgtctataattaaaaaaaaatatatatatatacacacacacatatacatacaaagtcaaactgaagaccaaatcttagcaggtaaaagcaatattcttatacatttcataataaaattagctctatgtattttctactgcacctgagcaggcaggtcccagatttcttaaggctttgtttgaccatgtgtctagttacttgctgaaaagtgaatatattttccagcatgtcttgacaacctgtactcttccaatgtcatttatcagttgtaaaatatatcagattgtgtcctcttctgtacaattgacaaaaaaaaaaatttttttttctcactctaaaagaggtgtggctcacatcaagattcttcctgatattttacctcatgctgtacaaagccttaatgttgtaatcatatcttacgtgttgaagacctgactggagaaacaaaatgtgcaataacgtgaattttatcttagagatctgtgcagcctatttctgtcacaaaagttatattgtctaataagagaagtcttaatggcctctgtgaataatgtaactccagttacacggtgacttttaatagcatacagtgatttgatgaaaggacgtcaaacaatgtggcgatgtcgtggaaagttatctttcccgctctttgctgtggtcattgtgtcttgcagaaaggatggccctgatgcagcagcagcgccagctgtaataaaaaataattcacactatcagactagcaaggcactagaactggaaaagaccacagaaaacaaagaatccaaccctttcatcttacaggtgaacaaactgtgatgatgcacatgtatgtgttttgtaagctgtgagcaccgtaacaaaatgtaaatttgccattattaggaagtgctggtggcagtgaagaagcacccaggccacttgactcccagtctggtgccctgtctacaccagacaacacaggagctgggtcagattcccctcagctgcttaacaaagttcctcgaacagaaagtgcttacaaagctgccttctcggatactgaaaggtcgagttttctgaactgcactgattttattgcagttgaaaaaaaaaaaaagctattccaaagatttcaagctgttctgagacatcttctgatggctttacttcctgagaggcaatgtttttactttatgcataattcattgttgccaaggaataaagtgaagaaacagcaccttttaatatataggtctctctggaagagacctaaattagaaagagaaaactgtgacaattttcatattctcattcttaaaaaacactaatcttaactaacaaaagttcttttgagaataagttacacacaatggccacagcagtttgtctttaatagtatagtgcctatactcatgtaatcggttactcactactgcctttaaaaaaaaaaaccagcatatttattgaaaacatgagacaggattatagtgccttaaccgatatattttgtgacttaaaaaatacatttaaaactgctcttctgctctagtaccatgcttagtgcaaatgattatttctatgtacaactgatgcttgttcttattttaataaatttatcagagtgaaaaaaaaaaaaaaaaaa

SEQ ID NO: 428 - protein, 619 aa, Homo sapiens
MSGIKKQKTENQQKSTNVVYQAHHVSRNKRGQVVGTRGGFRGCTVWLTGLSGAGKTTISFALEEYLVSHAIPCYSLDGDNVRHGLNRNLGFSPGDREENIRRIAEVAKLFADAGLVCITSFISPFAKDRENARKIHESAGLPFFEIFVDAPLNICESRDVKGLYKRARAGEIKGFTGIDSDYEKPETPERVLKTNLSTVSDCVHQVVELLQEQNIVPYTIIKDIHELFVPENKLDHVRAEAETLPSLSITKLDLQWVQVLSEGWATPLKGFMREKEYLQVMHFDTLLDGMALPDGVINMSIPIVLPVSAEDKTRLEGCSKFVLAHGGRRVAILRDAEFYEHRKEERCSRVWGTTCTKHPHIKMVMESGDWLVGGDLQVLEKIRWNDGLDQYRLTPLELKQKCKEMNADAVFAFQLRNPVHNGHALLMQDTRRRLLERGYKHPVLLLHPLGGWTKDDDVPLDWRMKQHAAVLEEGVLDPKSTIVAIFPSPMLYAGPTEVQWHCRSRMIAGANFYIVGRDPAGMPHPETKKDLYEPTHGGKVLSMAPGLTSVEIIPFRVAAYNKAKKAMDFYDPARHNEFDFISGTRMRKLAREGENPPDGFMAPKAWKVLTDYYRSLEKN

SEQ ID NO: 429 - protein, 4 aa, Homo sapiens
DEAD

We claim:

1. A method for identifying a modulator of drug-induced toxicity, said method comprising:
   (1) obtaining a first data set from a model for drug-induced toxicity that uses cells associated with drug-induced toxicity and represents a characteristic aspect of drug-induced toxicity, wherein the first data set represents one or more of measured genomics, lipidomics, proteomics, metabolomics, transcriptomics, and single nucleotide polymorphism (SNP) data characterizing the cells associated with drug-induced toxicity;
   (2) obtaining a second data set from the model for drug-induced toxicity, wherein the second data set represents a measured functional activity or a measured cellular response of the cells associated with drug-induced toxicity;
   (3) obtaining a third data set from comparison cells, wherein the third data set represents one or more of measured genomics, lipidomics, proteomics, metabolomics, transcriptomics, and SNP data characterizing the comparison cells;
   (4) obtaining a fourth data set from the comparison cells, wherein the fourth data set represents a measured functional activity or a measured cellular response of the comparison cells;
   (5) generating a computer-implemented first causal relationship network among the one or more of measured genomics, lipidomics, proteomics, metabolomics, transcriptomics, and SNP data and the measured functional activity or cellular response based solely on the first data set and the second data set using a programmed computing system including storage holding network model building code and a plurality of processors configured to execute the network model building code; wherein the generation of the first causal relationship network is not based on any known biological relationships other than the first data set and the second data set; and wherein generating the computer-implemented first causal relationship network comprises:
      (i) creating a list of network fragments, each network fragment including a plurality of variables connected by one or more relationships, and determining a probabilistic score associated with each network fragment based on the first data set and/or the second data set, wherein the variables correspond to the one or more of measured genomics, lipidomics, proteomics, metabolomics, transcriptomics, and SNP data and the measured functional activity or cellular response in the cells associated with drug-induced toxicity;
      (ii) creating an ensemble of trial networks, each trial network including a different subset of the list of network fragments; and
      (iii) globally optimizing the ensemble of trial networks by evolving the trial networks in parallel using the plurality of processors;
   (6) generating a computer-implemented second causal relationship network among the one or more of measured genomics, lipidomics, proteomics, metabolomics, transcriptomics, and SNP data and the measured functional activity or cellular response based solely on the third data set and the fourth data set using the programmed computing system, wherein the generation of the second causal relationship network is not based on any known biological relationships other than the third data set and the fourth data set; and
   (7) identifying, from a computer-implemented comparison of the first causal relationship network and the second causal relationship network, a causal relationship unique in drug-induced toxicity, wherein a gene, lipid, protein, metabolite, transcript, or SNP associated with the unique causal relationship is identified as a modulator of drug-induced toxicity;
   wherein the comparison of the first causal relationship and the second causal relationship includes generating a differential causal relationship network from the first causal relationship network and the second causal relationship network;
   wherein the differential causal relationship network includes one or more of:
      at least one relationship present in the first causal relationship network and absent in the second causal relationship network,
      at least one relationship present in the second causal relationship network and absent in the first causal relationship network;
      at least one relationship having a different directionality in the first causal relationship network than in the second causal relationship network; or
      at least one relationship having at least one significantly different parameter in the first causal relationship network than in the second causal relationship network.

2. The method of claim 1, wherein second data set representing the measured functional activity or cellular response of the cells associated with drug-induced toxicity comprises one or more of bioenergetics, cell proliferation, apoptosis, organellar function, a genotype-phenotype association actualized by functional models selected from the group consisting of adenosine triphosphate (ATP), reactive oxygen species (ROS), oxidative phosphorylation (OXPHOS), and Seahorse assays, global enzyme activity, and an effect of global enzyme activity on enzyme metabolic substrates of cells associated with drug-induced toxicity.

3. The method of claim 2, wherein the global enzyme activity is global kinase activity, and wherein the effect of global enzyme activity on the enzyme metabolic substrates includes an effect on a phospho proteome.

4. The method of claim 1, wherein the first data set comprises two or more of genomics, lipidomics, proteomics, metabolomics, transcriptomics, and single nucleotide polymorphism (SNP) data.

5. The method of claim 1, wherein the programmed computing system is employed by an artificial intelligence (AI)-based informatics platform.

6. The method of claim 1, wherein the programmed computing system receives all data input from the first data set and the second data set without applying a statistical cut-off point.

7. The method of claim 1, wherein the first causal relationship network established in step (5) is further refined to a simulation causal relationship network, before step (7), by in silico simulation based on input data, to provide a confidence level of prediction for one or more causal relationships within the first causal relationship network.

8. The method of claim 1, wherein the unique causal relationship is:
- a relationship present in the first causal relationship network and absent in the second causal relationship network; or
- a relationship present in the second causal relationship network and absent in the first causal relationship network; or
- a relationship having a different directionality in the first causal relationship network than in the second causal relationship network; or
- a relationship having at least one significantly different parameter in the first causal relationship network than in the second causal relationship network.

9. The method of claim 1, wherein the unique causal relationship identified is a relationship between at least one pair selected from the group consisting of expression of a gene and level of a lipid; expression of a gene and level of a transcript; expression of a gene and level of a metabolite; expression of a first gene and a second gene; expression of a gene and presence of a SNP; expression of a gene and a functional activity; level of a lipid and level of a transcript; level of a lipid and level of a metabolite; level of a first lipid and a second lipid; level of a lipid and presence of a SNP; level of a lipid and a functional activity; level of a first transcript and level of a second transcript; level of a transcript and level of a metabolite; level of a transcript and presence of a SNP; level of a first transcript and a functional activity; level of a first metabolite and level of a second metabolite; level of a metabolite and presence of a SNP; level of a metabolite and a functional activity; level of a first SNP and presence of a second SNP; and presence of a SNP and a functional activity.

10. The method of claim 9, wherein the functional activity is selected from the group consisting of bioenergetics, cell proliferation, apoptosis, organellar function, kinase activity, protease activity, and a genotype-phenotype association actualized by functional models selected from the group consisting of adenosine triphosphate (ATP), reactive oxygen species (ROS), oxidative phosphorylation (OXPHOS), and Seahorse assays.

11. The method of claim 1, further comprising validating the identified unique causal relationship in drug-induced toxicity.

12. The method of claim 1, wherein the drug-induced toxicity is drug-induced cardiotoxicity, hepatotoxicity, nephrotoxicity, neurotoxicity, renaltoxicity, or myotoxicity.

13. The method of claim 12, wherein the drug-induced cardiotoxicity is cardiomyopathy, heart failure, atrial fibrillation, cardiomyopathy and heart failure, heart failure and LV dysfunction, atrial flutter and fibrillation, or heart valve damage and heart failure.

14. The method of claim 1, wherein the cells associated with drug-induced toxicity comprise one or more of cardiomyocytes, diabetic cardiomyocytes, hepatocytes, kidney cells, neuronal cells, renal cells, or myoblasts.

15. The method of claim 1, wherein the model for drug-induced toxicity comprises a toxicity inducing drug, cancer drug, diabetic drug, neurological drug, or anti-inflammatory drug.

16. The method of claim 15, wherein the drug is Anthracyclines, 5-Fluorouracil, Cisplatin, Trastuzumab, Gemcitabine, Rosiglitazone, Pioglitazone, Troglitazone, Cabergoline, Pergolide, Sumatriptan, Bisphosphonates, or TNF antagonists.

17. The method of claim 1, further comprising, prior to obtaining the first data set and the second data set, establishing the model for drug-induced toxicity using the cells associated with drug-induced toxicity to represent the characteristic aspect of drug-induced toxicity.

* * * * *